United States Patent 11,667,974 (DIAGNOSTIC, PROGNOSTIC AND THERAPEUTIC USES OF LONG NONCODING RNAS FOR PATHOLOGIES AND TOXICITIES INDUCING HEART DISORDERS) - sequence listing, part 4

SEQ ID NO: 3085 - DNA, 11113 bp, Homo sapiens
gcttaggctgggaggcacagcgcccgtgtgctggaggcgagttggctccgggtgggggaggctggggttccaaaccagggcaggggaatggtggccctgcgtggctcgtggacctctctcagggacccctctcagcaggggccggaaaagcaggcccacacccagtggtcattgcaggaacttcacttgagctggtctgcttgtgagcctgtggtttggagaggagaagacgcacttccccatgagaaaaaggtggtcatccccatgggctccacagatgaggacaccggccctcagctctgccccctctcagaagccttcctcacctgggggttctgggtgaagggagctccccgccagagactcatgtgggatcgtgtgtggaccgtagagccacagagcgtcatctgtaagccagtttagatccaggctttaacttcagtttcctgtgtgacctttgagaagccatccctccaagtgcttcctttgaagggtgagccctgggtgcctctctctgagggaggcccttgctccatctgggcttgactgtgccacgggggatcagaagcaacatacattctgtcagcagctgccggaaatgctggagcagcagtcctggaggcggggtgaagcagtccctggcttttggaggaggcgtgagaagaaattcatggggggctttaattcttttcagattcccaaccattttcttctagctgctactgcctgcatttgtgtaacttagtttgcaacacaggtgacaagctttctctcgttggatgctcattgcagcactgtggggcgatgcagccaggcaggtgctattgcctccatttcactgattgagagactgagactcagagcagctgggagctctcctgagataacacagctagttagaagtcaagccaggtccccagggtagagctttcagtagtgtgtgaggacagcataaaatgaagtctgtagactgtttttttctctgagaagttcaagtcttctgccttgctgcttcttccctccaagacaataagttggttcggtgccctctccggtgacaaacttaggaaacatctcttcagtatgaggtagcagcctcctttagctattgtcacagccaattcacagaggtctaaggcccccagcttaattgatggttaaggaccaattccaccctattcctccacctccatcaaaaaaagcaggcaaacaccacttcatgcctactagaatggctattaaaaacaaacaaacaaaaacagaaaataacaagtgttagttagaatgtagagaagatggagaccgcatgcattgctggtgggaatgtcaaatggtggaatcactgtggaaaacagtttggcagtttctcaaaaagttgcacacttaccatacgatcctgaaattccactcccaggtgtatagccaaaagaatggaaatcagggatttaagcagatttctatacactcacgttcatagcagtattagtcacaataaacgcaaagtagaaacaacccaagcatccataaaaagatgaatgaggcccggcgtggccgctcatgcctgtaatcccaagcacttcaggaggccgaggcgggcagatcacttgacaccaggagttcaagaccagcctggccaacatggtgaaaccccgtctctactaaaaatataaaaattagccgggcgtggcggtgcatgcctgtaattccagctactcaggaggctgaggcacgagaatcacttaagcccgggaggcggaggttgcagtgagctgagatcataccattgcactccagcctgggtgacagagggaaaatctgtctcaggaaaaaaaaaaaaaaaaaagaaaagaagagatgaatggataaacaaaatgtgagctatacacacagtggaataatattcagccataaaaataaatgaaattttgacatatgctacaacatggatggacctcacatacattgtgctaaatgagatatgccagatataaaaggagcaatattatatgattccacttccatgaggtacctatactgggtaaattcatagagacagaaaatggaatagagattactaagggattaatgaggggatggggaaggggagctactgtttaacgggtagggaatttatgctggggatgatgaaaaagtgttggaggtagacggtgggatgaggacacagcattgtgaacgtacttaatgccactgaagtgtatactcacaaatgattaaaatggtaaatggtacattatatatatatattaacacaattaaaacagactgttaaaagaaagcaaacaggccaggcgcagtgactcatgcctgtaatctcagcactttgggaggccaaggtcacttgaggacaggagttcaagaccagcctggccaacatggtgaaaccctatctctactgaaaataccaaaattaactgggacgtggcagcacatgcctgtaatcccagctacttgggaggctgaggcacgagaatcgcttgaacctgggaggcggaggttgcagtgagccgagattgcactactgcagtccagcctgggtgacaagagtgagactctgtctcaagaaaaaaaaaaaaaaaaaaaaaaggaagcaaacaaacccaaatagaaaacaacaaccgaacaaacaaaagcaaaaaaggaggcaaaggaagaagagagggcccaagggtaaaggacaggggctggtgtggaagacacaacagtacatcatgaaaaggaacaaggtgtctctgggagaggtccaggtggtgctctgcccaaggggtcgcataccttagtgctgggaagagaggcattctctggggcctgagactcctgcagggaaactgtcccagtatcagccagagaagagatggctttcttttactgcatggcagcagccctggagccccggggcaggatcatatccctagggtgggagaagtgcccatttccaatttatttatgtgttttatccccagagtgggataaatgactatgaaactgacctaatatttatgtctattttaaggccgggggttgatatgagtgctttcttgatgaactgcgcccttagagctatttactttagtggaaggtttcttttgaggaggagattgggaaaagtcatcaaattccgtggttgctgcttcctctaattatattctcacttttgaataatttttaagcctttcggaagtagaagaaataggggcttttaaaatgatgggagcattcccaacaaaggtaaaatgctccctaccttggggcccagctctttactgtgagtttgtgacatctacttttatcattctaaaagtttcatgttgtccatactgcctgttaggaaacatggaaaagctggctttcaaacttggacttggagccaggcatggtagcatgtgattgtaatcttagctacttgcttgagctgaagactttgaggctgcagtgagctatgattgattgtgccactatgctccagcttggatgacagagcgagacctcagtctcaaaaaaaaaaaaaaaaaaaaaaagggactaaggctggcagagacaagaagactaaactttgtattaatttgttgtatggtcattccttgttttttcagaatggactcctctcttttttccctttaagcaacaagatagtggagttacaacccagcccctgccggtagatttctctgttcggtcccgaaggttaaagtccttagatgaaaaaggctggaatgcaaggtattgctattgccctaatttctcagagaagtaaactgaggctgagagcagtccgggggtttgttggaggccacagaaccggttagaagaggcgtggattaggatgcaggtattgtgactcattctgcagacttcccttggggttttcaatcttgtcctttctggtcatgcccatgcctgggtttagacacatgctgagggctaggcaggagtgtgttggatgttgtggggtgagtgtgggaatggagggtagctcttgcagtgctcaggctagagctggtcctaacccttccatggaggggggaggggtgatagcaattcaggccagaccgtttcttggaagggcagggtgtgagtgctgggtcaggctagtgaggcatagttctacatgattgcattcagcttgcaatagctgatggcactgatgaatggagtctctgggccactcctgaggctggccagctcccctgccttcccctccgaattcagatgccctcttttgaggttgctgttctggtcaggatagctaagctctttccttcagtaggccgttgttttattattctcagattatctgggaggggtctttagtctcctctcctcagatagatttagcacatctcaccttgatggttcctgaagaaaggactctgactttgagaggatggaaggtcggggagtgagctgagatgagacgagctggcaggagcgctggcagcgaggaaggcagctgcagggaccctatccaggtgctgtgttgggtccaggccttgaaggcaaactcctcctactccccatgtgagctgacaggagtgtctcagggagggggctgctgaggttgtcttcgggccacatggctgctgggcatggcactggattcaggaccaagactcccgggctctaatccttgctccttcagttcacgttcttctcttctctgggtcttagttttctcatctgtagcaggagccaaccaattctaaggtcactcttagattctacaggactctcactggaagagaacccaggaggggcgtctgggaggcggctgctcagggtggccaggtacgaagccaccaggcagaggcacaggaggcatccctgaatcaccgaggagtcacctgccatgagcaatctgtggtgagagagaaggaggtgcaggccagtcaggggaaggaggtgacttccaaaacgccagggaagtttacaagcaggttttgtctaagtgattggccagtaggcgctagtagcaaacaaaccagcgcagggtcccaacttggtcaggagtggaatgcttttttttttttttcttaaagataataaatccaatcaggtcttttatcttgtttagaaatcataaatttaacatgtattggggttagcagaccagttcaggggctgtttgggggcattgagtcattaggctgggagtatttacgaggcagagtttaaaggacaccatttaacaattcttggcctggggctgtcttggttgcagctttgggcatcttttgggattctgtttggaagttttgcttgttgaaatatagcttagaatgcagagaattaagtgccttttgaaaacattttcatcccatcctaggcagttaaattcccaatactttggaatcatggctataattcagtttacaaacacaaatggagtacccactatgtctttttattttagtttattttatttttgagacagagtcttactctgttgcctaaattggagtgcagtggtgtgatctcggctcactgcaacctctgcctcccaggttcaagcgattctcctgtctcagcctcccgagtagctatgatttttggtgtgcgccaccacgcccagctaatttttgtattttttagtagagacaggatttcgacacgttggccaggctggtcttgaacacctgacctcagatgatccgcccgcctctgcctcccaaagtgctgggattacagctgtgagccaccgtgcctggcccccactatgtcttactacctgcaagacacagtaccaagtgtttcaaggaaaatgacaattgaacaatactaggtccacagcaggtgactcaacatttcccaaattgtattaagtttggggaatttttattttcagataagaaggcacatcaacacacatctacatgctgacctacctgtgtctttttgttgtgggacttgggtcttggttcctgaaaactttttcataattgataggtgaaaataacaaaaatgtggtagacatgtcttggaatgaacactattaaaaagaaaaataggactctggaatacaaactggtttagacagtcaataaatgaatgtctactcagtgggcacttggcaggggtaaagaacatgctctccacttgagcaactgtgaggtgtatttcagttattcctccaagccatgtagcattattgccattttccagataaagacattggagcttaaactagttaagtggctcgataaaggtcatctagctagtacatggtaaagtcaagtctttctgactcaaaaatccatgctcttattaattaattaatttaagaaatattaattgagcctttctcatcaaacatgctgcctccacatggggcactctgtgtgctctaaggggaagaatcagacaatcaccaaacacagcacaatataacacattttgtaattaagtgctaatttaagagctatatgaattcagggaagggagaatatgtcagctggagaggcttggcaccatgtcttgagaggatctcaagctgggtctcagagcacagaaaagatttgcaggaaccatgaatagagaagagcggcagaacttgtgtctgggggcagtgagatgcagaggtaaattggagcagatgctttaactttgcaaggtcacctgctttgaggttcaattataactacctggagtggcctttcaaccctcaaatagtgaagagggtggtttcattgtctaactcccacgttcatctgccttaatagtgactagctctaagtccagaaggagaactgggaggggtgagaatatgaaatattactcattgacagcaatttccacatgcttcctaaaacaataaccaacccaaattacctacatctacacagatgacacaggtgatacaataatgaaataattgatgaaataataatgagaggagtcctaaaagtagagattttaaaagccctgtgttcccaagagccatatgctactagctgaaaagcgctcctttctgtgcgtgatcaaaaccttttctgttcccttaaaaaataatacattggtaagcaggtgtttcattggttgaagaggtcattgctcggtgtcaggttggttttcagagaacagaaatgacagttctatgaaatcaacttgaacaaggtatttaactcagcttctcagaagttgccaataaactttatttaaagagattctcagaggaggctgttgtggtgcctctaactgactgcatcctatgcccactcttccctctcttttggccttctttttcagacttgtgtaaacccaagaaggtgggatagggaaagagattacaggatggtttagtgctctgcagttggacaggagaggttggaagttgtggggtggagtcccagaagaacctggtggctccaagtggtattgtgtggcttcttagccatcacatttaatctccccgggggtggctgttgttgcgatcctctgctttgccactggtggtgactagtgggaacgtttctcatagggttttggatggatgtccatgtttatctcttgaggcccattaatttggttgcttgggcactgcagtgatgggtctatgccgtgtgttggaaagagcactagattataaaagaagacttggtcctggacagttctgctgcatggctttaggtgagttccttaaggtttctccatctcaatttccttatttgccatctggatagttactctagataatctccaagctcccttccaagtctgtgatgagaggccaaagatgtaaattcagtctcctcatggagtagacagtgctgcgttgtgccagaatcacagacagcagccctgtcctatcctcaccgtgactcctctaggtgagacggtcagtggttcagaccaaatcctttgtcttttttttttttttttttttttgacagagtttcactcttgttgcccaagctggagtacaatggtacgatctcggctcactgcaacctctgcctcccgggttcaagcgattctcctgcctcagcctcctgagtagctgggattacaggcgcccaccaccatgcccaactaattttttgtatttttagtcgagatggggtttcaccatgttggccaggctggtctcgaactcctgacctcaggtgatccacccacctcggcttcccaaagtgctgggattacaggtgtgagtcactgcgccaggccgagtctttttgattaaaatagctcccagttgatgctgtcagcaaaattatgtagacaatctagggcggcagccatgctggtatgcctgagaacaggtggcttctgtcagttttaaaaccagcaaagcactgggcaaaccagccaggcggccaccccaagaaggacagttcctaccaatttagtgttaaggtggtgccagggcaagtgacagcatcactaagaaatataaaaagattctagaaaaccctgattttccttggccattacttgacttcccttaaagtctcttcgggtccctattaagtaaatactgaaatttaaatgatgaaatgctttctcccccagcccctatgcctgtgtaactaagtcacttcctatcccagaagctagtttggacctggtctagctggtcttgcaccagatgtccctgaagtcaccttctcatcccaggcttctccttctgccttcacctgtcctagggtgggagctgaaggttcagaggagtcaggtgggaccgtggctgggcctctgccttggttctcacacggtctcccaagcccttacctcatgcctgtgaaggagcaacttttcttccgaaaagatcttttccttccaaaatggatgctctgactgggctgctaagaaatgtgtgaccacaagaaaacaagagctttaagagatgagcatggatattccatgcctgggattcttagatatcctgatttaagtgagttattcttgaagggagggatctgagagtggtcgtagagtctaaaagagcctattttataaagcacagcctataacggcttagacccatttttccttttcttctaaacctgttttgagttggggagcaaagcaagtggttccctcaagtgtcttcccttttacctcattctccttctacccctagctttgcttatgaggtgtttcctatattctctgagggcacaaaacacttagaagccgtattataattcctaaaatctatttgaatcacacaattgatataaacatgtatttttgttgtaaaatttaaaattttgtccatctgatggatgagaatgacctggtcttggtttaatacccatttccctgagtccctgaatgaccgtgtggagcaggtcctcctttactcctggccccctggctaacctgtatctaactgatataaactagaaataaagtttattgtgttaggcctttgagattggggttgttacagcagttagcctctctgactgatgcagggcatttcaaataatggcagaatacagaaatctttttgacctctaaaaaccataccacgcaggcccagccctacctgaactgtaagggaagtggactttgatttcttaatatctagcctatggtgtgaaaatccaagtaactacagagaattaaaatagccttttctccctcttctgtttctgtctccctcccattgccatctttacccattgtctttttcaacattcttttcctctctccctcttccaattcacaaaggaaaatagaaatgttcaaaggttaaaataggccaatagttctttggctatgtcaatgcataacaaattggggtagagaattttaacaattaaaaaaaatttgttctgaatcttcctttggccttaggtaccatctagaggattacagttgtagtggtgtcttttctcctctttctgggtggctaaatatttgcacctcagctccctccttctctttgtgtatgtgtatagaaataatttcaatgccctagcttaagatctggcagtgaaaaatatccttatccacttggagaaggtcatccaattctggaaaagctgtctcaagaaaggaccatacacgttttataaaagcatgattattaagtttcaggttgattatcatgcaaatgcttccatttccccccttaccccactgaatctcctcctacaaccatgagtaaaatgacatctgggatgttgggaatttaaccagccagtcaggaaggccgaacaatgtttcctcagcccatggttcacaggggttctgagggcctttgtgcggaactcaaggagttgttcctttaaacaaggtgccggcttatctcacactttaaaacaccctttcctttcaaagttaagtgtttatctccttgggaatatgaattggtacaacctttcgggaaagcaatttggcaactggcatcgggagacttaaaggcgttttctaacttgacctggcagtccctcctctagtgctctagcctaagaaaataattggagatgcgatcacagatgcatgtacaaggatgcttatcacagcataatttatgacagtaaatcacctggaaacagcttaaaggctggaaaaataagggaagggcaaatccactcaacaatggaatattatgcagcctttaaaaatagtgttttcaaaaaaagtttaatgacatggaaaaatattcatgttaatgtgttaagtgggataaaaagcatacaaaaccaataaattctaactttattgaaaatagtttgtttaggcacacagccctagaagataagaaataagcaaatacaagagagaggagttttgttctaacctcagctctgacatgtgctaactgcctaccattgactaagtggtttaaactctctggatttttttccccagggttgtggtgaggatctgaaagaatatttgcaaagttcctggcacaaagaagttgctcaaaaattggtagtagttgttattatgattcttatccctattatactggtaggagtttgtcagtgacaaaagctgggtaagaatagttttggggggcagccttcctttacccttgtaacccaaaaagtatctgagacaggtctcaattaatttagaaagtttatttttttattttttttattatactttaagttttagggttcatgtgcacaatgtg

SEQ ID NO: 3086 - DNA, 8390 bp, Homo sapiens
agggaccctgggctaaggaagcacaagctggagacaccaaaatggtcttcgcaactcgcctctatattttctgccctgctcctaagccagcctgttggccgactggcccttctccacagatgtcatcttgagcctcttacagagtttcagcactgacattaatgacaagatggatcacctacaggacaaccttggatcctcaaccagcctgattaagcattgacactgcatttgtcaccaccagctctgatggtttggacatgtagaaatgtattgcaggagaatatgcaaacagctgctgtaaggtgagctgatcgggacaactgccagcaggcagaagggaaggcataattaatgggcacccttcagcagagctcagagcagaccaaacgccaatgcagaaggctcaagaaagaggcaaacagactagccactgctccaggatgactgtggctctttatgagtgaagagaaagggtggagactgaagacagaactggggacagtgacaggcttggggaagaacagctgattcagcagtcccaagcatctgaacacaaggtggacattctccagggtgacatcgcaaaatacatgggtgaagacaacctagtggccgtgacttggagcacccttcctcacaatgaaggcattctgggccagcctgaaaaacagcatggaaataaatcacctaagtacaagggactggcttaaaaatggtctaatgaaatgtcaaaagagttctcctgtggagcttcggagaagtttccttaccctttaaaaaaagaaaagaagaaaaggaaaaggtgatgatgatgacacacagaaggcatacacatttccatttctccctttggaaactttcatgtctgggttgagaagttaacagaaaggcaaacagcctgaggtcaaagatgacacactgaggataacaaaatggaaagacaatctgagctcttgatgatgtgtgactgaatgagccaaattaaacaactatagagctgttctacttccaatctaattatgtgagggataaatgttaatgcgctttttctttaggttttcatttagattttgtagtttctacggtacaaatcttatattcttttattgaatttcttaaacaaaatgttcttttcagactatataagtggaattgttttcttaatttcattttcagattgtttgtttccagtgtacagaaattccactggctttgtatagtgatgttttctacaacagtaatgaactcattaagtaactctaatagcatttttgaggactccttaagacttttcacacacaagatcatgtcatctgaaaatacaaatagttcttctttactccaagtaaaaagacatttttaatttctttttctagcctaattgttctggctaaaaattctagtacaatcttgaaagaagtggcaggagcaggcatcctagtcttgttcctgttattagggagaaaacttttaatctttcaccacgatgtattagtgaactgtgtgggcttttcacagatgccctttatcaggttaagaaaattatcttttcttccacgttttttgagtgtttttatcaagaaagtgtgtcagattctgtcaaatgctgtgctacatcttgaacctggaaagagaaggttgcagtgagccgacattgaaccactgcactctagcctgggtgacggagactccgtctcaaagaaaaaaaaacaaaaaaaaacagactaaggaactcaatggtaattaggtacttatgacctaattactcaggtaattatgacaacattttcgtgcctatgaattataatatcaatgtctcttctgtttctctcaaggaaaaattttaggccactaataattctaacttagagatattagcaacaacttggttcctcatgattataacttaagtcctcagtaaaagaatagtctcaaataactgaatacctacatgaaaaacctctctgctaactacacagcccacctccattaaatctacagactaaaattaccctatttgtgcatatatctcctaacaacactttgcctcccaacttgactgtgtgaccaatacacaaaaatatacatgctatttcaactgggaggaatgttgtggaaatgaaagcttttagaattaaaaaacaaaaacaatcctctctttaaaagaccaatacaccagaaataccaatgtttaatttggcacctcagttgtagacaacagccccttttctaactttatgttgcttctcagcattctgtgctttttcccctatactccataacctctgctggaagtataaaaaattccaggattccgtattactgtaggttcagctccttagagctcagtcccagtcattcactggcccatccaggaaactacttcctctcatttccaaggcttcctttaaatattccccaagtttgccttatctaaaacctggctttcttctgtcttcagggagcttacaatccagtatgggaatcatcgggaaaagtaacaaatgatgttccttggatttgtttttgtaattgcatgcactcgctatggaaagctaagaagggcatcaaactccaactgggggtaaagactcaaaaaaagatatctatagtaggtttatatgcaagtatgacaaacatgtttgaaaagaatgaaggttaagacagacacactagttgataggctaggcctgaaataataatgaactgaactaagaaaaaagggagattgacttcagataccctttaagctatgtcaaaagttttttgttttttttttttaattgaaattctaatacttacataggaataggaacttgacatggaggacacggtaatgcagtctgaataaatgctggctcagaaggctgttcccaagggcctgtaggctggtgctacaaataaaatacataagaattttaagtcagagggattaaatcatatggccattttaagaatctaagaaaatagttccatgtatcctctgctcaagcaggttgaaattttttcaaataatcaataaattgtgcttactgaaatatttcattttatctgtattaaatgaaattgttcctctccacagacatttgatattaataactgagacagaatccagtttataaatggtagaacaaaggcagtgtagcctcctttacttccaataaggaaatgagaaaaacaattggaaactccaacatctagcaattgaatataatctccatcattttactcactgttgttcctcagcacctaaaaaaaagcttgatatttagtaagggctcaataaatgttcatgaggctgggctggacgtggtgcctcacacctgtaatcccagcactttgggaggcggaggcgggcagatcacttgaggtcaggagttcgagaccagcctgatcaacaagctgaaaccccatctctactaaaactacaaaaattagctgggcatggtagcaggcacctataatcccagctactcaggaggctaaggcacgagagtcactgaacccgggaggtggaggttgcagtgacccagatcacaccactgcactccagcctgggcaacagagtgagactccgtctcaaaaaaaaaaaaaattaaataactaaaaataaataaatattaaataaaatattaaaaagtgaataaatctttaaaataagattataggagatatctataaccctaaaccacaatatatgaaggaggactgccaaattcacctgtatcatgatcataatgtaactatcacactgtatttgcaaacaatggtttcactcctttcctacactgtgagttgcttaaaacaaaatcaagtcttgattaccttgtaccctgctccaagcacagtgcttcccaataagtgcttaatcattgctcattgaaaaactaagtaaaagcaagaaagtacaacccacagcaatgcactatttctctaatagtattattcccttaccctgccagtctgctttattaatgcttgatcatgacacggagcaggacacaagtgaccacatttctccaaaactttttggcaaggttgatgacatggtggacaagaaccaaagtgacagcgatgtttttcttgacttgtatgatgacaagttggtggtcgactaaatcataaagtacaattttcaaaaattacttttagtcattgaataattacatctaaaggacaattatctatttacatatcttctgattccatatagaatgagtatactgtgaatattaatattttaaaacactaaagcaaaattaaattattaaaagccaatatgaatttaaatttgtacaacatcagatggaagcttgtgcaaagcttcaaactcacctgcattgctccttgcacttgggtggtcttgtggtacgttctcggccacagggcactgtcacctttgtattgccacaattacacttcacatctacggtttctgggcagggatagcaactgcctgaaaaaaaagtctgacaattaaaaagtttccttaactacccaaatgcctattaatggtaaaatacataaatttagtatattcacacaatgggatactctacaacaagaatgaagaaactacaacaacatgaatgaatcttaccacaaaacattgagccagacacaaggagtacatagtgcatgattccatttatataaagtaaacaagaaaaaatgtactgttcaaaatcagagtgatagctatgaaggatgcaaggaaggtgttgaaaattttggtcatgttctgtttaatgatgtaagttttggttacctggctatgttcagtttgtaaaaattcaacaagctgtatactttttatttgtaatacttttctctttttttttttgtaacagggtctcaacctgttgctcaagctgagtgctgttgcatgatcacagctcagtgcagcctcaactttctgggctcaagcaatcctcccacgtcagccttccaagtagctgggactacagacacacaccaccatgcccagctaatttttgattatttatagagatggaggggtctcactatgtcatccaggctggtctcaaactcctggactcaagcaatcttcccacctcagcttcccaaatgctgggtgtacaggcgtgagccactgcacccagcctctgatttataacacttttttctctgtacactggtacctcataaagttttagacatttctctaaaatgtgctaaaacttctgttctaaataacaaatttaacacattactcattcaaaactaaaacaagcaaaaatggatttaagtctttggaaaatttaacattaacaataatatcgttggcctactttcatacatctatccaagtacacaatttttagatgaattcccaataacttctttctcatgacctgatattggttagtagcaagcacagtcaattttccattaattgtgctttgtgaaagactaagtactaagccaccattttaggatataatcccaaatatttctcttctaaacataaaaaaaaatgttattttggtttcagctttttacgctcttttgttatgggttggcaaaaatataaaaaaacaaaatcaaagaaatctttaaagcaggctataaagttcgctccaagaggttctgtcatcatcttaagggctttcttccactctagttttcccagtaaggaactctatcagaaatgaaataataaaggaagaagagttttcaatgaagaaatgaatatcttaaagagactgttgcctaggtgtcaggaccaagcaaaacatggaccgggagttaacctgataaaaaaaagattaaagatggacaatatcctggcttaagtgcctctagaagttcaaaatagttccctaaaacaaacacaaattaagaattataattcaaataatgaacacagaaaaagagaagattagaggtaaaacatcgtagggtcaaacataacatttattatacaaaacaccaaatgtgttttgacacatatattcttgatgttaatgcaagtcaagttatcctaacccacatatcaagttttatttttattttacctaaagaatgactacaagttgtatttttaaagttgatagtgatatttaagtcggttctcattcggcatattatatctgtttctatacttaacaatgacaatttttcattcatcttcagcagaggaacctttttgttatcaaacgtaacctttttgttattctaaacaacagtatcacatttaaattacatcttgaaaataagggacaatttctctaaacagtctccctactgaccaacagaatttattataattaaaagagcttccataatactttcaaaatgaagaaatagcatagggagactataactatactgaccaataccagttaatagccaaaataggcatgattcgggtagttctaaaactataaacacagatgatcctgaatttaaaaaaaaaaactataaatcggctgggcgctgtggctcatgcctgtaatcccagcactttgggaggccgaagcaggcagatcacgaggtcaggagatcgagaccatcctagccaacatggtgaaaccccggctctactaaaaatacaaaaattagctggacatggtggcatatgcctgtgatgccagctgctcgggaggctgaggcaggagaatcacctgaaatggggagtcagaggttgcagtgagccgggattgcgccactgcactccagcctggtgacagagagagactccgtctcaaagaacaaaacaaaactataaatcaaattttcacatacccacaacacaaacatgcagttagtatattccccctataaattactgtataattctgattatgaaggattctagaatgatggaaaaatggtatgaaattatgattccacattcttttataactgtagatgaaacaaatattgacagttgcacaacagcatcttccacatactttacatcaaggaaaattttgttgtgactaataagcttttctaaggattaatagaaatctataaaaacaaaacaaacaaaaaaacaccactctaccaaaaaatatcaaaacctgaatctgatcaaacctctagatccaattaacaggttatcaaaaatatagaggacagaggaacatgttaaataataccacagagatgcaatctgcaaaactcagactctgagaaactaaataaagcaacctagtttcttcaacaaataagtcataaggggaaaaaaggagatagaggatggaaattataaattaaaagactttagagacaaaaccaattacaacatgtcaattttattaggtttttgagtctataaactgatgtaaaaaatgaagttacttatgagacaacaagaaatttgaaaaccagatgtttgctgatatgaagaaatatgttaactacatttaggttaagaatccatcttttagagacaaatactgaaatatttatgggctttgcttcacaaaaatatgagacagggaaatgcttccaacacttctccagtaagtatgatatttgctctaaactttttgcagatactctttatcaggttaaggatatgtctatttccaattaaatttttatcttatatagatgttagacatttatcaagatgatctcattcctcctttggtcttttaatgtggtaaattacataatattagatttactactgttaaaccagttatatcacagagatgtagtttgcaaaaatctgcaaaaactcaatgggtcagtgatgtaatgactataaaagaaaataaaatctttctagtgttggtgagagcatacctgaaaaactatttctaaacttcactgacaaatcaaagaacacctacaggaaatgtctacagggtaaatagaatctgacacttttcctaatggggaaggaatgtagtataatggaaataacataaacactgggttcacatcctgactctgcgactagttctattaaccttgggccaatagtctcccggcctgttccacatatccctatatgctgcaggatttctgaaaggatagggagatcaactgagaaacagttcagtagtttgttctaggtattaaactactaaatggcagagtctaggcttaaatccaggatttcttactctaagtccacgatctttccaatactgtataccatatctcagtagattccatttcatatcaacataatccaaatgagtgaagttaactcagtttttaatgtctagtaataacttataacataattctcaaagtatagtccaggaaccctagtggttcttgagaccctttcaggaggtctgcaaggtctcacatgcatagttttccagaagctagtgaaaagtgatgtccatagcagactgaatacagaagcatatatgtgaatccggctattttctgttaag

SEQ ID NO: 3087 - DNA, 444 bp, Homo sapiens
tgggaagtcaaagttcagctcaaagagattctgattaattctgggtttccagaagattgtttggtgacacaagtgtttactaacactggaccagataataatttggatgttgttatctctcttcctggcctttggtgtgtaccccaatgtatgctatcataaggaaaagacaaagattctcaccactgaagggtgtaatgcacttatccacaaatcatctgttaattgtccttttagtagccaagacatgaagtacccatctcccttctttgcatttggtgaaaagattcgaactcgagccatctctgctaaaggcatgactttagtcaccccactgcagttgcttctctttgcctccaagaaagtccaatctgatgggcagattgtgcttgcagatgactggattaaactgcaaatatctcatgaagctgctgcctgcatcac

SEQ ID NO: 3088 - DNA, 23509 bp, Homo sapiens
tctgaaacagggatgtgtcctacaatcaccatcagccaggaagtggtcaggatgcagtggttataactggattattttccctggcctggctgaccatctgcaaccccctggtgtttcaatgtacaaactattttaggaccatctgcgtactggctgttgcctgaaaatcttgtgttgatgtggatttgtaagactgggaaagcaccagcattcaaaacttgaagaaaggtgttagcagtttggcagacaatcctacagaaaactctttattcttgggggagaaaaagttgcctcccatcaacttcaatggttcacaggatgatgacgtgtggggaaacacaaacctcgacaacattgagtccaaatgtgtttcggaagactcagaatgaagaagaagatgccaaggaaaaccttaaccaatttattttcctttttaatgagtgatatgtgatttttcaaaagcctaaatacatctaaaagagctatatcagttaagtataagataaaaattctaaaccatagaaagcactgttactgcttaattgacagcaatttttctttctttgcaatgtataaaataatgggtgctttttatgttcactgaaattcatattgttgtctccttttacagctgggaaagcggaaatctggagaactaaaatatcttgctgaagatcacaatgcagtaaagcatagggcaagtttccaactcgaacatcaccccagaacacttccttttaaacataaattatgttgctaacttttttattgttacttagcaggcagatttcaaactgatacaaatgttgaaaatgatacaaaatgttttcccaccttaaaggcattctgaaacctagcacataacatctgtcactgaagtccatagtttccaatgccatgattggataaagaccctattgagactcatgtgtttgtctctcactgcttaaaacactcatgtgttttaagcaacatgacaagcacaaaagagaacaagtactgctcctgctctccaggaagttaccataaaataaaggggataaggtgccttccaaagaaaaaacaaatactaggagaggtcagaggagaagagagattattccagaaggagagactgaggcagatttcaggagggaagaatataagagtcccaaaagaagaaacaggaacccaggttagagagcaatgggcaaggggtaggaggtgagactaaactcacaaggaagttgcttcaaaacaatagtgccccaaatgccaagctgatgggttggacccatttaggaaaaacccacaaagtccacaggagagcagactgcacttccatgagcttcaagctgtaaacagtaacctcaaataaaacttttcccggatcggtaatttccatcctgaacaatggccaagtcaaggaagctgaggatcgagccccctaccgcatgccacaaagaacctcaagggaccccatgctctggggagctcgcaggaggaccagcacagaggtgtgactgcgttggggcagggtggccacatgtacaatgttgtaccttccaatgttcctccttaggctgtgcttatgaagtcccaacatgtcttctgggctgtgttttcaaccaagagagttaataaaaagtgggatgggcaccaactatgcctccagagacatcaggcagaatatgccacagcgtgccatgtcctcctgcaaacagtcagaaagaaaagatctctaaaagcagattggaagagactatatatacagagcgagtgccggtacagaagttttgctgcaaatacaccctctaatcccttgcaacccactgcaagctcgagagaccagtgcccttggtaaaacataggagagatcattaattaaagcctaggccctttctttgatcctgagggataaggcttgggaaaatgcacagtgataaaagtgaacattttaaaagagcagagtgagtgtgaattcccaaagagaccattcatatcaagacccaagccatgagaaaatgctacaatgcccttgatcaatactttataggcattttgacctcagatctaatcccatgaggcttagaccaagaccttgcttgatgcagacctctctgactgctgaaattggtcaggagctcagtgatgaaaatttggaaagtcaatgctgatacctgaagaaagtcccatcagagatctgtgacctgaatcttcataactttcacaggccctttctaaatgccaaggaggatgtgtgtggagaagaatatgccacctatggcatcccaatatgcctgtgcccgcctgctcttcaacaagggaatgaaacctgggtattctcataggttttttaaagcacttgtccacatattttattccgcaaataacacaatttaaaattcagctagaatttgccattttctgtcagggttgtgcatttcttccagtcaccatgacttcctgagatagccaaaacacaaaatttaaattgtgtttaaattaaataaacacaatttatgctgaagctgactttacccactctgttccaacattacttatcctcagcatctctgaattcaaatatcagccaggtgtggtggctcatacctgtaagcccagcactttggcaagccaagatgggaaggttgcttgaggagttggagaccagcctgggcaacatagcaagacccccatctctacaaaaaaattaaaaaattagccaggcatggtggtatgcacctttagtcctagctacttgggaggctgaggtgagaagatcacttgagcccaggagcttgaggtggcagtgagtcatgatcataccactgcactgtagcctgagcaacagagcaagaccccatcccttaaaaaaaatacctgccctctgtacttcatagcacctggggcattttgaacagttcttccttcacctgaggtcattatttgagaatccaattttagagactacaatgctctcattacttggattgtatcatttaatcttcccaacaatccaggaaggggagtctcttaatgattgtccttgatttccagttaaaaaatctagacccagaggtaaccttgtgaaggtcacagagtttcagagttctaagatcccatgcgagattgctgaacttgaacttgtttcttctgatctcatgtcaataagtgacttagtcaacacctgggtagaaatcatcactaaagtgagaaagcacatggtgagggggatgaatcctgtgcccacatggtccctttcacctgcccaatcctcaggcctctcacctggggtacccctcacacacatggcactttcctgaactcatggacatttcagtttgtaacgatcctcctaagattatctactttcacctatccacatttgaactatacttctttagtggaaaaaaagaaataaagccagtgctgagaatgatcaaactccagaaatagtagactgctgtataatttgtcttgcgtgacaccagatctttcaaggaactgcaagctcaagtgcacagttaagcaagatcaagatctacctttgtctttcagagccttcccttggcgaggtcaaggatatctgctgtgagcctgggctggctgaaccaaagggcaatggaggcggccaagaagccccagccaactgctcccctccccaacccccttctccctggaggtcccttcagctagaatttgccattttctgtcagggttgtgcatttcttccagtcaccatgacttcctgagatagccaaaagcatttgctgtgagcagagccccatggctggctttgcacatcaaacatttcagacagccatatatttcatagaatacaaggggaagataacactggacacacagaactttccaacagcttgagaaaatgtggtgcctggtgactgactaaatatacaatcggacaacagccaggccatagcaaaagatggaactctgatccacaaggtgcagcaactttcccagaaaacaatacccttacccacaaaaagcaaccccggaagctggcctgctctaaatcagacctgctggaagccaaattgctctctagtaactatccaggaagctaaataataacttctgtaacaattgactcaaaatgttcaggactggattaataactgatggcttccctaatttttgtccccgattccaacttaggacccaccagagaaagccaaatatggtcccctgaccaagcacacaggatgttcgcttctagtgagccgcctccagcttccccgcattgataacctccaatcagggcacacctgaagccttcgcctttttccactataaagctctcccactcgtctgcccacctttgagtctctgccaaattgcaaatgatggtgtctgactcccttgctgtagcaagctctgcataatagcttgtgcttattctctttgggtaggtcttcatttcttttcacaccagataggcatcatctttgaaaacatctttactgggtctcttgtctccctcctgcagccactgatctaaatcacagacttttttagaaagagggaaaatagtaaagaaagaaagcgattgagttgatgctcccagccactgtctgtaccctgaattttgtttttctgccatatgtcaggtggcctctcctggaccatcgtcactgtttctcctgcttccctgcagctgcagacacaggagcactgtgtaggtctggccttgagcacccacccacccagtacagagccagcccctgctgttctgaatcagtgcagtgaccacttagaacacagtgcccatgcctctgtgatctgaactgctctttccagttccatacaatgttaagaacccacttaagaatgttttaatcattcagtagtttttcgtggtatataataaaaaagtgatttaaatacaatctattttattttagattatatcattaggggttattttacaaagttacctttaaatactattgtaaataaaattaataacaaataagcaaaattcttacttttccttgtttgacaattgacatggtcaatttaatttcctttaaattaattatgcaagaaaaggatatttcctcaagaaaatttaaaatgatatatatttcttggttgggtgccaaatattcattcagaagaagacggaaatttaaatccttgtttctaatttaaggaaaaaactactttcattattggatgtgtgaaattcacccattttgtgtttatctagaaaatctagtttattgtccaaatgttcttattttccccaaaagcatcagttaggagagaagatttccagctgccattaaaatacaattgtgtgcaatgaatacattttgggtatagatagtttttattctctataaatgaaatgccaaattggatagaaccatcctttttttttttttttcaaaaaaaaaaggcttttggagtatcagagacatcctcttatgttattttaaaataaataattatttgagctgtttgcttcttggaagcagataacaagggggcaggtgagataaaaaaaaaatatatccaaactgaggtgagaccaaagatggccaatctaagaaccaggcagatgtctctgcctgtcctgggaagattccctcaccaggctccctcactggccagaggagcccacttgttgggctgccaactggttcctataaattctaaggcaattagaatcatgtggtgactgtaacgggaatgacacagctgcccaggcattagaaggaaaccacacccaatggctcaagccagtggcgagagataaaaactgagagacatctcccctgactagcagactgggctccctgcttccccattgcttcctttaaacaggccattcacacatttgcctgaaaacttacagtggcccagaccctactccctatacacactgccagttgccatgtgccttgtttctctctctctgcatgatgcttcattcctatctggagtggcccagggacaaaggactgccctcccgactctctgtgccctccctgcccaggatccgtaaattacactttttgaatttgtttcctactgtggtgtatattgcctttgcaccttccatctgaagaccaggggatgccccaggccaggttttacctgggatgcccaagagagcacaaggtttggctcccagcgccagagcaatgggcaggggggcataaactgaacacaggaaaggcaagagccacaaagacatataaacaagtttcccaggcgaggagcccctggtcacaggtcagacaactaggcattgggccatctaccaggtaaaagcagcatcctatgaaaggcacgcagtaaataccatgtccatctccccttcatttccccttagggcggtttgctagctgttctgggactggaacctcagtttagctgggggctctcagaacagacagctagatgaattaaacaatgaagtctctcagccttaggcacatcttccaggacaaggggaaggccaggggagagtaacatcagtgatcctacaagatgtgcttccaggccaaggccaggttgcagttgcagctacttagccatggtacacggtgggcctggagcttctgggtgtgcaaagatgtgactcaagagtccatctgccagcagtgagcagggcaggccagctctcctctcactggtacggtggttccagccctcacaggacattaaaaccacctggaaactgtttatgaaggttcctatattcaggaaaaatccctagagattctgaccgaaggaatttggtgctgcctgggtaccagtatttttaaatttccccagatgatcctaacatgcagtctgagtgaaaaacccaagtttgacggctacaggaatttagagcttctctaaaacatacagggaataataccagggccatacattggaagtccttccattgggaatgcaaagaaaaaagaaaaagatggccaacatctaccattttaaagggattccagcaagcatattattaaatgcagggctgcctctggcatctggaagcagcttgggtgccctggatataattctcttttaaaagtttttttcacagcttttatagaccacttaaaactggccttcatcttgtgccaaaatagcagggctgtgtttgtttagcttcaagattttcaggtccaattgattaaaaaaggtgagtgagaagcctgccaacacacagtgaggctgtcacccaggcagctgctgctgctggcttccagcatccagaagctggaacatcagccagctccaatcacctgacagaggatggatcctatgagaaggaggaccggggcttaaaaccagacgtacccactgaagtcagggcaggagatgaaaatcttaacaagtgaaggaggtatgaaaacaacagattctagggatcagcaaccaatgaatgagggtccattttttgaaaaacaaatacttctactggctgtcttttgagtgccaggcattaaacaaagtggaagaaaaaaattggagggtgactcaacagatggaccagatcaataatgaggggtaatttgagcaggacaaggctggagctggaagtgcatgcaggatgccagcatcagagcagccaggcatcagagagccagccttgactactcgccgggcctcaggggctgagccttcgtcccaggacaagggagtggccagagcttggctggccccgttccagatgaggactgtgataccagtcaggtcaacgagcaccgatagaggtagggcccaatataggaccgtgtctcacaatggtgcagacccgcagtccaacacacaggaaggatgcttgttgctaagtcttagacacgggaactggaggagggttgagggcccccagcagtgggaaggcaggcatggcatgcagacggtggacgcggactcaagacaccaactctcatcactacaggtccgtggtttggaaagtcccagcaccattccagagaaggaaacaggcccaggtttctgatggggatgggtagtagccacagagcacaagtcagccgcacccaccacacacttgctgtagtgccacactctcggccctagagggcactgacgctttcccttcgctctgccccagggccagggccaaagccatcaagtcctgggcagagggcgggagcgttcagtgagagcagcacagaggttaaagagctgctcttttttgagatcttcgctctcacttcctttccaggcagccagttcagcaaggtgggtctggggctgcctcctgggagaagaggcctttcaccctcgaaccctgcaggacctcagtttgtcccagggcaaacctcctacattgggcagttaggtcagacctgcttcaggccttggaagactgtcttctccttggcttctcttactgcactggatccagccaggacactgatcagacctccagggcccaggttaacaatatgtggcccagctctgggagagaagccagcaggtctcccaggcttttgaactcggagctgaaaaccaaacaaaaaaacgaatccaccccattgacaagtggcccagcctagttggccagtcaggagactgcacaggcactgaggccaaagctgccttggattaagaggtatggatgccaccgctgcccttttactacaggtacactggccgggaacctgtagcactgagtgacacctgatcagagagtcacccactggctgggtctcccccaactcagatgcatggctaacaatcactagctaagcatgtattcactctgtggaaagccacgtcacgttcatatatttattatctcatgtattaatatactgatgtaccacattattctaatttactacctcacttaattcttacaacaacctaatgtgatgggcaatattattattagctccattttacagatgaagaaacaagacctgaaaaggttaaacaacttgcccaagatcatccagccaagtcatgataaagctgcacttgaacacacacttctcagattccaaagcccaagtttctctctactaactgtatggcccctgcactcaaaaactgagaaatctctctgccctggtgagtttcttcctctacgtcagtatgcatagagctcagggctgtactttccttcactagtgatatggtttggatctgtgtccccatccaagtctcatgttgcaatgtaatcctcagtgctggaggtggggcccggtggaaggtgattggatcataggggcagtttctcattaatgatttagcaccagtggaaggtgattggatcataggggcagtttctcattaatgatttagcaccagtggaaggtgattggatcataggggcagtttctcattaatgatttagcaccatccctcttggtgatgctgttgccatagtgagttatcacaaggtccggctacttaaaagtgcgtggcacctcccccacccccctcctcctgctctggccgtgtgaagtgctggtttccccttcaccttccgccatgattgtaagtttcctgaggcctctccagaagccaagcagatgctgccatgcttcctgtacaatttgcagaatcataagccaattaaacctcctttctttataaattacccagcctcaggtatttctttacagcagtgtgagaacggactgatatgtctaggaaggacagcaacaacagaatccacttttgctatcggctttaaaccaaactatcctctgctgaacaggaaaattgaaacagaaatagagaatggaaaaaaagaggtgactaaaacacacttaaggtgtgtacagtgaaaagggagagaaacaatgggctctctaaattacttttcttaatgtgtattacaccacactcaactggatatattaatatcatcatggttcttccaaaaatcaataattacctatctgtagtagatttcctatactagcctacttttcttccttttttcatttctaacatcctagttaattccatgactcccaaggtgttgccacatccatccctctgtgtacaacatggccggattacgcttcctaaagtctggttttaatcatgtcactactccgctaaaacatggtaatggctccctaaaatgctcttatccttagcctacaattcagagctctgtgtatcctggtcctaaccaactctgaagagctaccacaatactaatcctatacctgggccaatctagactactcttcctcctgaagaaatagctgagcttttcctccatattcagcccaggcatatctagctccattccactgtggccaatgggagaacacagctatcaaaaaagaagagacattgagccaggagctcatgcctataatcccgtgactccagaggctaaggctaaggatggcttgagcctaggaattcaaggctgcagtcaactatgatcttacctctgcactccagcctgggtaacagagcaacaccttgcctcaaaaaaaaaaaaaaaggaagggggatcttgtcctgttctctactgcatcctcagtacctagaaccagatctgacacttcctagatgctccatgatatttttcttttcagtaaataaatggaacaggccatttcctctgactgaaaagctctctgtccaggtcttcagttctcaaaatccttctgtctcaataaatactgtggcactttttagagcatggcactgaaactctttgacacacctctcattgagacttgttatagtggcccttcccttgaatcagcacaccaggaatgctggaccaataaaacacaatggaagtaacactgcagtggttataaaaatatgcccaccaaattctttaatactcctcctttggggtaaaacctgtttccttccccttgcctgtgggctgaactgaacttagtgacttgcttctagtcactaagcagaagtgatgctgtgtgactttgaaggctaagtcctaacaagacactgtggcttttttttttttttttttttttttttttgagacggagtcttgctctgtcacccaggctggagtgtagtggcgcgatatgggctcaccgcaagctccgcctcccggttcatgccattctcctgcctccgcctcccgagtagatgggactacaggcgcccgccatgacgcctagctaattttttgtatttttagtagagacggggtttcaccatgttagccaggatggtcttgatctcctgacctcgtgatccacccacctcggcctcccaaagtgctgggattataggcgtgagccaccgcgcctggcatctgtggcttctgtcttatttggtctctctccctcagatcactggctctgaggaaatcagctgctatgttgcaagaggtcctagggcacagctcttgtggcaaggaactgaagccgtctgttaacaacacatgcatgagtttggaagcagatctttcagccccagccaagcctttagacgactgcagctccaaagtgtgtcttaacagcgaccttatgagaccctgagtcagagccacccagctaagtcactctggactcctgtctctcagagactgtgagagataaaggtttgttgtttcaagctatgaagtttgaggagccacttattacacattaatagagatgcataccagtgtctgaattcagaccttaagaataagaaatttccatttcctttctcttgggacacttgctcttggaacccagcagccatgttgtaaggaagccaagctgcctatagagaggcccacatagagagcactcaacagccagaccatatgtatgcaccgtcttgggtgtggattctcccaccccagttgagccaccctagctgtccctgccaagccctgcccaaattgtatttccatgggcaaaataaataactggtaatattttaagtcactacgtcttaaagtgacttattttttattaggcagcagtagataatgaaaatagattttggtatctggatatgggatactattgtaacaaaatcctaaaatcgaggcattggttttgggacttggtagtaggcagaagcctcatgggcctccgtgaaggatagaaaaaagtaagaaaaatatatcagaaactagaaaaaaaaagatccttgtagtggcaaaaaagtcactcagttaccaactgaggcaatataaaaaagagtccctaataattgtagttagacatccaaggagatttccaggcagaatacagaagtgcccactgacctcctgtcaatgcctgtgatgaaatgcaagagaagagagatgaattaaagaataaactgttacatgtaaaggagctagatctggccaggtttgaaaatgaaactaatttgttattcctactctctgcaaatggcaaatagttctcaaattaagaaaggacctcaggccatagatcaaagtcaggatggatgtattagtcctttctcacactactataaagataccacctgagactgggtaatttttaaagaaaatagatttaattgactcacagttccccatggctaggaaggcctcaagaaacttacaatcatggcggaaggcaaggggaaagcaaggcaccttcttcacaaggtggcaagaagaatgaatgcaggaagaactaccaaacacttgttaaaccatcagatctcatgataactcactcactatcacgaaaacagcatgggggaaaccgccctcatgatccaaacacctcccaccaggtccctcccttgaatgtggggattacaatttgagatgagatttgggtagggacacagagccaaaccatatcaatcagtctataaatctaagcgaatcatagaaacttgaagagagacaaaagaccccctaagaatcttaaggacctcccttaagatcctctccattcagggcagatcacaaggtcaggagattgagaccatcctggctaacacagtgaaaccccgtctctactaaaaatacaaaaaattagccgggcgtggtggcgggtgcctgtagtcccagctacttgggaggctgaggcaggaaaatggtatgaacccaggaggcagagcttgcagtgagccgagatcgcgccattgcactctagcctgggcgactgaacgagactctgactcaaaaaaaaaaaaaaaccaagatcctttccattcaatagggcttttaagaatcttacctaatggagtgagggtttgcccattctgaaggtattgaaacaggagaaaacagaaatagcattatatgcaggagttgcaaacaaatgttgaccaccttaacactagtatcacctatggggacagcccattgactgaaaggccggtccaccaaagagcatacagagcaaccagaaaatagtgaggtcaaaaggtcagttaccaggagggttaattcaggtcatccttcagcagatcaggcctcaccaattttctcagctgaccaaagagctaaaacaggaaacctgcgccatacgcaatataccatcttgggcattttccctggagtctgaagagagattgttcacattggagtgaggctatctctgctgcctgaattatacatttcttcccttgggcttaacacagactcatccaccggtattcctgggaaagatatattgattaagaaaggcaaaaaccctaactcagaagcaagactgtgttcaatcttctttttttttctctcagcaaatgggcccataatttcaagtaaatggcatgtgaagctgttaagagccaagccccacatttgcgctgccatgttctactggttgtaaataatacgcgtgactgcaccagggaccaaattgctctttagctgccaacattagttgtttaatgatctgaggagcagaagctgccaattattgtattccttcttaaaataccatttaaaacacatacatgtaattattataactttttgttaaatttttatgattcttttgaagctgatgagctctgggtccattcaacctataaaactcagagaactttttgaagctgtcattacataactgggttaaaaatccatatataatacaccgagagagggcctggactttagccccagatctgccactgcttagctaattgagtgaccttaaccaaaggacacatcccgcagcctcaacctccccatcagtccattcggatcacggtctctctcccatctacctaatatagcaattgtgaaaataaaataacaaatccagaggagtgtttgaaagcactaatgataggataagatactgttttcagagactcttgacttcaagctactaattaatggaaaaatcaattccttaataactgccagagtaagagggagcataatcctttgaggattcgccaagtttctatgactagattttcaaactgaggacattaatttgtctcatgttaccatccttccctctatagaaagggtctgatcacacccaataatcctcattcagtatttacagatacacaatgctacatacacatctgctagaatcatatggcacacagagtacatttagtctctaaactcttcaagaaacaggaactagaaatcccaaatacggtactcacttaaacaccttgtgctatattatgtgcatattagtgaaacttcccagaaaagctttcagatgtctgagaatgacataataacagtggaatgttcatcgaggacaaaacacgatgtgctggtagctgtcattattttagttggatagcttcaacgtctcctacactgccagttacctgatatggcatgcattttggcttcaagcaaggctggtagttgggtttcaatatcgttaactttcttcctcagggtgctgcagaatttctcactcatacacacctagggggagagaaatgaccaggaatcatcatttattcagctaaaaatcagaaggcagtggaacagccaggaatacaacaagaagtcaaccgtctgcagcctgtaagagggcctctcaccagaacttagccatgctggaaccctaatcccagacttccaggcttcaaagtgatgggaattaaatttctgttgtttataagccacctcgtctacagtactttgttatagcaactcaaatggagtaggactgtatgcaaacaaaacaacccatttttgatatttgggaaaatctaagatctttaatagtagttggaaattttcagcaaatcctaatattgggtgcgtatcagtatatgtgtgtatccacaatatacagtgtcatacacacacccatataagcaccatctgcattatataataggcacacctgtatcctcaacgttggtgtacagatgcattcatattacccatacagtatgttctgaagatagtcaataaactcagacccaagacagtcctcccatcttttaattctacatagaaatcaggacgcacctgataaacagcagaaaatgtaagagaggccaggtgcggtggctcttgcctgcaatcccaattttgacacactgaggcaggaggatcgcttgagctcagaagttcaagaccagcctgggcaacctagcaagacctggtctctactgaaaatcaaacaaatttagctgggcaaggtagcatgtgtctgtagtcccagctacttgggaggctgaggcaggaggattacctgagcccgggagatcaaggctgagtgagctatgatcatgccattacactccagcctgggtgaaagaacctttgggtgagcagagcagaagtcaagcatttctgggtccctggctccgatgctgtcttacgggcaccacttgttcctaacaggaagctctctttgtacacaagttataattacccatcaaacctgcggctctgtgacctttagcaaaatcactgggtgttgttttcagaaataaattagatacagaaatggagaaaatgcacagagtaactccagacatttttgccaacatcacatccctgattctggcttagctgcggtgatcccttggcgtgtttcctgatctagggtccaagactttctttctctgggcacagagaccggaagagagtccttccaggccaacaggctctcagctgcgttgctctctgctcagcaagctgtcctttttacatttcgaccatggtacaaccacccctcgttcccagaccaactgcaaataatgaatgattcatacccagttctctgccacaacatttagtcataattcacagagtaattgatcctgtttctcagtctgtcaataacttggccaggtataaatacatatgagaagggcttttgttttgtaaactgtggttatcctaactaatgaggacattgactatttaattgactgtgctctcagggaatagtgaagacgtattctgtctgtacacaaaccaaggtcttgctatggcagtataaacgatggataaagtaggcaaaatgattgtcaagccaactgaaaagctttaaagaacaaaaaaacagtcaccaactgttctatttgtgaggaaaccagacattgccctcctgggaagaaaagtaattaatttctcaaattactaccatcctgaaagcattttttttttctttgagatagagtctcgctctgtctcccaggctggaatgcaatggtgcaatctcggctcactgcaacctcaaccacctgggttaaagcaattctcctacctcagcctcctgagtagctgggattacaggcaccctccaccacacccagctaatttttgtattttcaggagagacggggtttcacaatgttggtcaggctggtctcaaacttctgacctcaggtgatccacccacctcggcctcccaaagtgctgggattacaggcgtgagccaccgcaccaagccccgaatgcatctttaagcaaaggctttcaatatgcatagtggcagtcctttttcagtccctaaattgacagctccttttgtagcaaaggccaaaccagtccatttctggggtgtccacaagtcaagacctccactatgacagaagcactctctcctggctcttttaactcatcattgggcctgcaaaatggcttgacaaagtctacatctttttttgcagaagccaggtatcctaagatctagatgtaaaatcaagtcaaacgaaaacttcataggcttctttggaaaatgggaatataaaggtacttaccttagtagtgatttctttaagtgacaagttgagggattttattctttcctggaggctggaagaattaaaaagaggagattggtcttcttggtaaccacaattcaataccactacagttaggaacactgcaaaaagtgaaccttccactggtctgatggacgaagaagtgcaggaggaaagatgatgccaaattggctccatttgactacggaataaatatggtgctaggaaacagacctttcctcccttattatgccttactaaagctagtattacaattttatcatgcccagagtgtacatctactgataacgggaagaacagccaaggtgtgctcctggcagcaaaggattaaaatctgcattcctataacaaccttcccagaaggaaggtctacactgagtagtgtctcaccagcagggaatcaaatagtatctatttgggtagacaatgcaattcagcaaatatgtacccagagccctctgcattcggcattgacatagagcataaaggagagacacatatttaaagtatgtctgagatagcacccccttagccttctcctgcttctcttttctccatagcacttttcatcttgacatatttatttattcatgtaatttctctctctcccactggaacttaagttccatgaaggcagcgactgtctgttgtgtccactcctgcatccccagtgcttaaagaattcctggagcttgttagtaagccctcagtcaatacctgtagaatgaatgaatcaatgcaattaagagtcagatcttattctgaaggttgttacctagtagagaagaaacacaggcatgcaattcgctataatataaagcaagaggaaaaaattactataaggggaatagaaaatcaatactaggagaaaactgctacataaaagctgtcaccaggcagaatattgtctgccttgagcaatggagaaaataacttgtgcagcaatttagaactaggagattggtgggaaagcttaccagaagaggtgaaaagtgaactgggcctcaaagggaaaaaaaaaaagagaatgaaattctagcaagaagataaatctaactggaccaaatggttctcacaggtgagttgtgaaagataaacagggaaatgactatttctggtaggaaaagagagagaaggatggggtggggcctatctgtatctataatgtttgcttatttagttagttaggggccgggcgtggtggctcacgcctgtaattccagcactttgggaggccttggggggtggatcacctgaagtcaggagttcgcgagcagcgtggccaacatggtgaaaccctgactccatctccaaaaaataaaataaaataaatttatttagtcagggaaagaaaatcaaagtaaatatggggtaaattctactatttgtttaatcctagtagtggataaatgagtgttgtatttttaaatatgtttgaaatatttacaattaaaatatttttaaagaaatatcaagggcaagctctagtcagtattaaatgccagactaaggagttttgagttttatccctcaagcaatgagaaatcattccgttttctagcaagagagcaatatgaaagaagtgtttttgttttttagaaaaataattgggctgcactatgagagatgatttggaggaagaaagtctgaatgtgacaaaaccagacaggcctcttcagcagtgtaagcccgtcatggggtccatgggccccgcagagtgatagaggtcagaaaggggagggaagaacaggactggattacgtggatgctcacagcagtgagaacatccattctagagttttccactctttcatgcattcatgaactcactcattcttcaaatatctatctactgggcacccagcaagctaggaacttagagcatgaagacatggttcctgccctcaaccacttactgctgctagaaatgccagaaaatgtaatagatgctagaagaggagtgattacttgattaaatgatgacctgcaaaaggaaaggtcaaggtttctggggtatgtgttgggaggggaagggaaagtgtgcagggtgtcaggaaatctcataccagaggttgccaagtatcggagctaagctgccaatttgctgatttttgtttgtttgttcttcaactgtaagaactatattttgatgttatcacatccaccaatttgtcacttctgagtataagcaaactcgtttcaattgtaaatacctgggaactggtgcaggtccgtactaatcagtcattaccactttagacctactttcaacagaggagggttttccagtccagctgagatcagcccaaatggaagaagtgaggtttgacagaggtggggcatgtgacaccagactcttcagaattcaggagctgccatctgacaaaaattcgtgtactcagtgggaacagtggaaaacaatgtttggaatcctgcctggagaatgctagactctggctggccagggattggatcttttgagagaacataagtcagagtgtcacacagacatggagattggggcagatgaaaccacttagggtggtgagaaggacagagggcatccaacatggacccgtactggttcttcctctgattctaacagcagcaccagctttgggtggctaatgcctgctgcccaaactgaaaaccttccttgggcagaaatgcactttcccttgctgggctcgttagagtccattcaacaaatacatttttaataaatggttcaacacatcattgaacctatatgagcatttaatagtatattataagtaggtgttcccaatcacacacaaagactagcccatgcattaacaattcagataggtagtagatcctcttactgatactgaaattttagctgaccaaaacagcagtgcctttagctaatgcccaacatatcacaaaaaaggaggtcaagcaccatctttccaggggttgacacagttcacttgtctgggctgagatctggccctatcccagaaagaaaatcagtctcctctcagatatccatgttagaggaagggggcagtgatgcagataattaaatgcattgttttatatttaatttgatttataattaatttatgctatattcctttttgcaacagatttgccttcccaattacgttttgctcaggctactattaacattagttgtatccctggggtatatacagaataaaagcaattgttgggggagcagacgatatgaggaatctatatactatgctagtgggtttcaggctatttatagtagaagaattctctcaaaccaaagtttacacagcactataaaacataataaagataacagggaatctgcttttattgaagtggggtgtctggcctagggtacaaagatgtcacattagtcccccaaacatacacacatgttgctgctgccatcacactgtggtccccaaaccgtaattccaggagcaggactacaaaccaaaaaccagaaaataagaccagttcaatgctgacaagcaggagttccgtgtactttaatgagtgaaaccaatccccactttttaaaaaacttgcatattattcataacaaacaagaattatcctctcagatgaaattatgccttaccctagaaacacacaatttgtccaaacaaattagcgaacacattttcagaaacacaccagacctaatttacccaaatgagtatcttcattcaaagtggctgccctggaaataatagaatccaacatttattgaacacttactatgtaccagacactctcccaaattctctatgtagatgagcattttaaattcttattataactctatgaagtagaaactctaattatctacattgtaagacaagaaaatttcatcaaagagactaagagaggtttaagtaactttcccaggggtaaccagctggtaattatgggagattaaacagtaacccaggcagtctaactatctgctctcctaactgttgaacaatactaactaccgctcccagaagctgtgtacctatttaaaatgaactgtcatccagacaaatttttggaattctatttcagaattttgttcaatgtacaatataatcaatatcatgatttgtaaatacacattattctttactcacaaactggtgttccaatcatatgaccaaatttcaccctcaacaaatgaaaccttacaaaaattgagactactgacatgaatgtgctgcacagaacgcacatcagcagcagatgagcctggggggtggctgtggcaaaagaaaattaaatgcaaaggtgcctgtcaccggttgagttgtgtcccccaaaattcacaggttggagtccgaatccccagtacctaagaatgtgacgatgtttggagatagggcttttcaataggtaataaatttaaaataaagtcattagggtgaaccccaatccaatatgactggtatcattataaggagagatgtggaaggccaggcgcggtggctcacgcctgtaatcccagcactttgggaggccgaggtgggcagatcacaaggtcaggagatggagaccatcctggctaacacggtgaaaccccgtctctactaaaaatacaaaaaattagccgagcgtggtggcaggcgcctgtagtcccagctacttgggaggctgaggcaggagaatggcgtgaacccgggaggcagagcttgcagtgagccgatatcatgccactgcactccagcctgggcgacagagggagactgtatcttgaaaaaaaaaagaaaagaaaagaaaagaagagatgcggagacagacacatgtggagggaagatcatctgaagacaaaagagaagacagctgtctgcaagccaaggagaggagcctcagaagaaaccaaccctgctgacaccttgatcttagacattcagccttcagaattgtgagaaaataaatttctgttgtctaagccaccctgtccatggtactttattacgacagccctagcagactcatgcatgtggaattttccatttcttgtggtatgatgagttataggtattattagggcaccgcacactggtgcttcacgatccaggtaaaaagagttgctactccatgtagcagcagcagcaggtccaacagaaaacacggcactcttttgttttcttcagactgacggtttcttttcaatctgcccaactgggagactgtgggctgctacaataaacgtgtgtagaacattaccattcttgtctatagtttaggagctaagtattatgaatggtggctctaagaaaatgttatgtgagaatgtctttgatttttaaaaatgattattatggatttttaaaaatcatttttaaaaatgattacggattatgattttaaaattattatttaaaaatgattcattagaaatgaaaaagggctcccttcaatactcttgcaatatcacaaacagaatgcaaccactgatgtcaaaaatatgagtaataaaaattcaatcttgggggacagattgcttttcagccgtaattagaagggcaaatggaatttaagtcaataacagtcactaatctagataatacaagccaagacttggtcaagggccagaatgagacatttatacaggaggagacagccaggcaattttggttcaatgacttgggagtgagaaactattctaaagataactgatctgaccaaagaactgtctctacttctaccactctgctccaagccacgggcacctctcctctgaaatgctgcaatcgtctctgaacagttcttctgcgttcaccctcactcctctacagtctgttcttgagatgtagccagggtgagccttcacaagcatgtcaaataaaatgccactactcactccatcacacctgagtcgagccaagtctgcaagggcctatatggcccatctctcatctcgtctcttacctcctctcctacagctcccttctttgcttactccaccctggccacagaggcctcctgacagctcctcaaatctgctgtggctggtgcagggtccactgccttgaccttctgccccagcacacataatgggccaaccccctcccacctgcaagtctttgctcacctctgaccctctcagtgaggctggcctgactactccattgacagctgtaaatttcacatccactcgtcttccaccccaatccccaggtcatgttcattttctactaacctacatgtaacttactaatttattatgtttgttatttatttctgccttttactactagaaaaagaatttcatgtgggcaaggatttttggagaagtacttgaagtgtttggtacacagtgtgtacctaatcagtatttgattaatgaacaatactcacattcttgtcttctaagaaataagtg

SEQ ID NO: 3089 - DNA, 2587 bp, Homo sapiens
cactccagaaggagtcagatgcatgcattctgcttcctagaacgaaaaagatggatttgatgtcgtgaaatggcaattctaaaactcaggagatatgttggtgtttctgagctcttactccagtgtccacttgtccatagaatcacctttcacttctggggtcagaggacagctcctggaatgatctctcatcttacggcaaaaaggtaagagaacttggctgggcacagtggatcactcatgtgattcaagcattttgagaggctgaggcaggtggatcacttgaggtgaggagttcgagatcagcctggccaatatggtaaaacccgtctctactagaaatacaaaaaattatctgagcatggtggtgtgtgcctgtagtcccagctgcttgggaggctaaggcatgagaatcacttgaatccgggaggtggaggttgcagtgagccaagatcatgtcactgcactccagcctgggcgacagtgagaccctgtctcaaaaaaaaaaaaaaaaaaaaaaaaaaagaaaagataaaaaagaggtaaaagaacttagtctttagtcctgaatctattactaatcacacaatgtttcatatgcaaattacttaatccctctaaccctcaccagacccacctatacaaagggaatgacagtgccaggcttgaagttaaagctctagaggtgtctgcctaatgaataaatgggtaccacgaatgaaattcaagaactggtgggggttgatgtgtatacaggggtattagagaaactctgaagtttttttcagccttttgtttctgattagagttaccttttaaaattttgttgtgcaatatgggaatattgtaacatttaagagaaagggggaggagagataaagtagagaagcaggttctataaaatggcaacattaagttactctgatgtagcacctgagagtttacttgagtatctcctccaattcagtattttacatcaacctcacaatacccttccacagggagactcatgtactagaaacagtgcagcaacttcactgagaagataaaattccatactgtggttttacgtcaaagtacacattttcagaaatatcactctttaatatatttagcaattgcatggatgatctactatccctgaactaaaattactctctctataaataatctgcaatttggcaggattttgtgcagatgcctcagtgccctcctccttatatgcgtgtgtgtatgaatttattttttgacatttgcattttttattgactcttcgcgactttggcaaggtgaaaggcttgtggtggttagggaccatgtgctagtattgcgagtggtttgaatataatgcctttgccagtgagcaaccgacactgtttagtttctgagtgccattctccaatggattcctattgactctaaaaacatgcttggctagtcgaagaaattatttgaactatgttggagacttcagtcaatggtccagtaatcacactagtcctttcattctaaatgatccatctcgaatgactttatcacatggagttctctcttatgtgatttatcctaataagacagggtacccactgagaatcatcattgtattataggcacagtttacgtaccacctctcactgtgtgctgtgatccccagggaggaacatcagtcttctactataaagctagcattaggatctacctgaggaagctcagcattctcctatgagagtgttcatgtcagaatcaactagaatttatttcacattattgagattctggtgctccctttgaggcaaacatttaaatataaaaatgtgaagagctctgacatgaatctggtgtaatgaccataaataaattactggatcccacaataaaagtgcattttctttttttaatggctaaatataattttcatgtgttttttaaaataaaatcaccattaaaatttaactattttaattattactgaataagtccattttttattccttgtatatgttcacaatataataatatggtcttcacgtacatgtgcatagctgtgtatgcttttatatatatatgtgtatgtgtaaaataagaagaatagagcatcccaaaactcctaacttcaaaatttggtttgttacttcattggccatatatttcacacctaatctgacataatcacaattttatgtagaatttaaaggtaaaaaagatgtaaataaatggataactgcacggttcccaatctgaaaaaaaagtagaataaatatttacatgtcaaaatgtattcgagaattgtttcttgttttaacaccatcatgagagttacaactctgttagtgtatcaagtgttctgaggtctctttccatagtgacagacttttagtgttgtttcattgggaatgggaggttctcaaaattatttgatagcttttttccatgaacatacataaaagcattaggttcttgcagaattggtgctctactgttcttatttttgaaaatattgaattagaaactttgtatacattttctaatgtactcttacttttccatgggtttttgtaggggctgtttgttattttatttatctaag

SEQ ID NO: 3090 - DNA, 9072 bp, Homo sapiens
cacagtttctttatccaattgttgattgatgggcatgtgggttggttccacgattttgcgattgtgaaatgtgctgctataaacgtgtgtgcaagtatctatttcgaatatgacttcttttcctctgagtagatacccagtagtgggattgctggatcaaatggtggttctacttttagctctttaaggaatctccacactgttttccatagtggctgtactagtttacattcccaccagtagtgtagaagtgttttctgctcactgcatccatgccaacatctaccatttttgattctttgattatgaccattcttgcaggagtaaggtggtatcgcattgtggttttgatttgcatttccctaatctttagtgatgttgagtattttttcatatgtttgttggccgtgtgtatatcttcttttgagaattgtctattcatgtccttagcccactttttgacaggattgttcttttcttactgatttgtttgggttggttggagattctggatattagtccactgtcagatgtatagattgtgaagattttctcccactctgtgtgttgtctgtttactctgctgactgttccttttgctgtgcaaaagctctttagtttaattaggtcccagctatttatctttgtttttattgcaattgtttttgggtttttgatcatgaaatcctggcctaagccagtgtcgagaagggtttttccaatgttgtcttctagaatttttatagtttcaggttttaggtttaagtcgttaatccaacttgagttgatttttctatcaggtgagagatgaggatccagtttcattctcatacatgtggctagccaattatcccagcaccatttgttgaaaagggtgtcctttccccactgtgtttttgtttgctttgttgaagatcagttggctgtaagtatttgagtttatttctgggttctctattctattcctttggtctatgtgcctatgacaaatttatttagaagaaatattttcttatcttttcatgctttgctttagatattgctacaaactttatttaatagtaattttaaattttgactagtaaagttatgtgaaccatgtacggcaaaataaaggatttcacttagacttgtttgcagagatagcaccttaagcttccattagatctgtttttatcagctcatcttatctctgagctacctgacactttatctgtctcatcaggtacaatcatttaaaaaccactgagctaggttatcttaaaattttctttaaaatatgcaaataatatatttatcttttttgataaaacatttaacaaacagaagtctcccctttacttcactcttcgaaattccactcccctccccagaggtaacctcttacccatattctctgtttggctctgcgttcatgtttgtttgtgtttgagatggagtctcactttgtcacctacgctggagtctcactctgtcacctaggctggagtgcagtggcacgatctgggctcattgcaacctccgcctccccagttcaagcgattctcttgcctcagcctcccaagtaactgagattacaggcacctgccgccacgcccaactaatttttgtatttttagtagagatggggtttcaccatgttggccagcctggtcttgaattcctgacctcaggtgatccatccacctcagcctcccaaagcgctaagattacaggcgtaagccactgcacccgggctgtttgttttgagaaagggtctcactctgtcacccaggctggaatgcagtggcacaatcatggctcactgcagcctcaacatcctgggggcaagcagtcctctcacctcagccttctgagttgctggggctacaggaatgcaccaccatgcgctgcttctttttatttttttgtagagacaaggtctcatcattttgcccaggcgggtctcgaactcctagggtcaagtgatcctcccacctcagcttcccaaagtgttgggattacaggcatgtgccactacacgtagcttttgtttttcattcaacagtatggagctctttgcatgtgactgtttataatttttctcatcttttttaagtgctttgaaggattccaaagtatatcgatggacatttagtttgttttcagagctttgtagttataagtaatgctgcagtgaacatcatatgtttacatatctaacagtttatataatagataacagatacacaataaagaatagatgtggtaggtgcacatttattttgtaagatactactgaagtgctttccaaaatgtctgaatcactgcacactcccagcagtggggagaatgcgtttttccccagacactcagaaacagtaattaccatagctaatgaatctatgacatcagtgaacacacttggaagagtgagaggattactctattcccatcaccgcgttcattttcacagattcctagggcaccctgcaaaagacattcctggggagatggggccgacagggctccaaccctaatctgacaaagggtccattgtgactactgatgcacaggtgcctgtgtcagggcaagtgaaaggagaaggcacatcagaacagagaaccctctaacctgggaaatctgatctgaaagggtagcaaaaaagaatgtgattgtgactcccatgttaaatacaaaagactcttagcagttgccctgtgttccaagccactatttttgaccaagatcaaatcaatagcctgtaacccacatacttcatgtagaattcaaccagctcaccactgagtgaaaaccacggcaggcactgtactgggctggctaagaaacagccccttccctgaaggatcatacagcccaagatggtagttaggagagtaaatcactcagtgggattggccatgatgggagttggcacagggtaaacacagaaatgagaaactgcagcccaaaagggagggctggagaagaacaaggccttgaagaatgagcaggagttccatggataaagaaggaaataagtggtttcactgacagagaaaaagagtgtatatgaagcatggaagcatgaaacagtatgaccagtttggagaactacaagttgtcaagtgcttgcagcaacgcaaggttagagaggtcaacagatgggtccagggatctataattgccattttgtaaatcaaatcatgttggaaaaataaatttacttaacattcacactaccctcttggttgctgagtcactgaattccagaagcctctggggacaacaactcattgtagcagaggaagagaaaaaagatgctactctgtcctcaacgttactggttagagacagaaccaggctgaagcgacccagtggtcttattcataagggcaagatgaggttctgcgaacagttctccatgtagtggtctttgaatgccatcctaaccacgtatccaggggactgcttttaacatgattgcaatcttataagtacaaatgggccagcacccttcttcctatcctttctaaccacctgcaactcagtaaagaaacgaactctgcaactcccatttattcattcaacaaaatatataggcaggaaaatgtcattacaacgtatgcttctaggcaggatgaaataacaggagtcagattcaccttctacctgataccacagaaaaaacagacaaaatatatgaaatgaagatttttaagacattggatatgagatatctgaaaggtgggaaacaaggagagccctgcttgccccagcctactgccatgccatggagagtttgcatgccatggagcagaaagagggagcaacggtagagcctggggtatctctgaagtgtgatagagctgggtgtaagtagcagaggcagctaaagattacagggcaagggctgagtgtggagaatagctataggaatacaaaaatatccacacccaataatgtaaaatatacaatatctgacatccaatgaaaagttgccaggcatacaaagcagcagacaaagatggttcctaatgagggaaaaaatgaattaatgaaaatcagccagaaataacacagatgatagaattagcagacaaagatgttataacagttactctaattgtactccagtgctcaagaaggtagaggaaagattaagttatagaaacatggtagatatggaaaatactcaaacctgataaggggcaaatatgaaagccatacagctaatatcatacttaatggtaaaatacatttctcctaagattgagaacaagggattgttgcccactcttactacttctatcaacattgtactggttgtttcagccagtgcaaccaggcaagataaagaagtaaaaggcatccagattgaaaaggaagatgtaaaattgttttttttttttttgaagatgacatgattgtctatgtaggaaacctttggaatctacaaaaaattttaaaaattactagaatcaataagtgagtttaacaaggttgcacgatgcaagatctctgtataaaatcaattatatttctatcttctagcaatgaataaccagaaattgaatttcaaaacaataccatcagtgatgcaggaaactctgtgagtttgcaagaggcagaataatgacccccaaatacgcccatgtcctaatccccagaacttgagcatatgttaccctacgtggcaaatggaactttgcagatgtgattaaggacctgcagtgaaggagatttatccaagtggacctaatctaatcacatggatagcagataatttttttctgctctgtcagaggtgtgactactgaagaagggttgcagtgagatgcaattctgctgactttgaagatggaaaaaggaagccgtgatcccaggaatgtgtgtggcctccagaagctggaatgtgcaaggaaatgggttgtctccttggggccctagaaaggaaggcagacctgctgacaccttgatgtcagcccatgtgatctatgctgtaattctaatctatagagaactgtaagataatacatttgttgttttaaaccactaagcctgtggtgattttttatggcagcagtagcaatctgtataggataaatctgcaaattatcagtaaatcctacacactgaatactgtaaaacatagctgagaggaattagacaaaacttagagctatcatgttcatggaagacttgatgttgttaagatgaaaattctcaaattgacctatagattcaaaccaatcccaaacaaaattccagcagattttctagtagaaattgttgattctcaggttcatatagaaatgcaaaggacctagaatagttgaagaaatcttggaagttgaaaagttggaggacttatactacctgatttattataataaagttatagtgaggaaaacagtgtgctaatggtataaagacagacaaatatatcagcagaattgaaaagagtccaaaattagatctgcacacataatacagtcaattgattttcaacaaaggtgcaaatggaattcagtagagaaaggataagcattttcaactgtgatgctggggcaactggatgttcaaatgcaaatacatgaacattaatgaaaacctcacacatatacaaaaactaattcataattgatcaggctgggcactgtggcccacacttgtaatcccagcactttgggaagccaaggcaggcagcttgcttgagcccaggagttcaagacctgcctgggcaacatggcaagaccctgtctctacaaaaaattagccaggcatggtggtgcatgcttatggtcccaactacttgggaagctgaggtgggaggatcacttgagtccagggaggttgatacggttttgctctgtgtccctacccaaatctcatcttgaattgtactctcataattcccacatgttgtgggagggatccagtaggacataattgcaatcatgggggtggtttcccccatactgttctcgtggtactgaataagtctcatgagatctgatgattttatcaggggtttccgcttttgcatcttccacattttctcttgatgccactacgtaagaagtgccttttgccttctgccatgattctgaggcctcccgggccatgtggaactgtaagtccaattaaacctctttttcttcccagtcttgggtatgtctttatcagcagtgtaaaaatggactaatacaggggttgagacttcagtgagccatgatcgtgccactgcactccagcctgggggacacagcaagaccctgctacaaaaattaaaaactttttttaattgatcagtgaactataaagcctctagaagaacatgggaacatctttgtgaccctgggttaaggaaaattttcttagatataatgctaaaagcatgatgcttaagaggaaaaaattaatacgttggacttcatcaaaatcaagagcttaagctcttcaacaggcaccaaaaagaaaatgaaaaaacaagcctcagagagaaaatgtctgcaaaacactttatcagataaagaacttgtatctataatacatataaaactcacaactcaaaaataagaaacctgacaaccatgtttttaaaatggacaaaatatttggacacttcaccaaaaagatatatgggtaccaaataataagaaaacaaccggcagggcgaggtggctcacgactgtaatcccagcactttgggatccgaggcgggtggatcatgaggtcgagaccatcctgagtaacatggtgaaatcccatttctacgaaagatacaaaaaattagctaagcatagtggcacccctgtagtcccagctactcgggaggctgaggcaggagaattgcttgaaccctgtaggcggaggttgcagtgagtccagattgtgccactgcactccagcctgggcgactgagtgagactccgtctcaataaaaaaaagaaagaaacaaacaaagaaaaaaaaaacctatttttttaaatgcgcaaaatgtttgaatacttcaaagacaatatatagttggtaaataagcacatgaaaagatgctcaatatcattagttattagcgaaacacaagtcaaaaccataatgggataccactacatatgtactagaatgtctaaaaattgcaaagactgataatacaaagcactggcagggatgtggagcactgggattttccaagtgtaaaggtggaataatgtaaaatggtactttggaaacagattaggcagtttcttttaaagttaaatacacacacttagcatatgataaagccattccaatcctaggtatttactcatgggaaatgaaagcatgtctattcaaaaaagtgtacaaaatttttcaataacagctttacttgtactagccccaaaccagaaacaacctaaatatgcatcaagagattaatgaataaacaaatgagtatatccatgctatggaatattattcagcaatacaaggcaatgaagtatcagtacttgctacaacatgagtgaatgtcaaaatataatgctgagtgaagaaagcaagaccaaaaaacatgtatactgcatggttacatttagataaatttctagcaaatgcaaactaatctgtggtgacagtaagtcagggcttgtctggagatggggttaggtgggggaaaggtgagagggagggattacaaaagggcatcgggaaacttttggggacgataggtatgtttattatcttgattgtagtgacagtgttacatgtgtcaaacagcaaattgtacattttaaagtatacttgattatatgtcaattatccctcaataaaggtgtgaaaaacgtattgagaatacattcaacaatacagatggttggctaggtattggagataccatgttgaacaaaaaagacaaagcaaggtctctgtcttcatggattttaagatattaagcaaagaatcttcccttccatttctttcatcagtttccacttctgcccacatacttgttctctctggtgattctttattgtgtgacaggagcaaactgttatcaccaacaggatttcttaaatcatcgcctcaggtaagggctgctagagttggttgatctaacagtttgaaactagagtttgcagctatttggaataggatgtaattttcctatttctgtttacagagaaagttataatcatttttgtgcttagaaaaagcccgttcattttcctcagaagagccagcactgggttagtaacaaaggctcaattcaaagacacctaagaagacattaagaagagtatgtgttctctggctacaggtgaagaggctggatgttctatatctacatgtggctttctcttttccctgtgaaccttggggttgggtgtgagaggatgtgagtggtaactaatggcaggtctggggcaagagtaatgaatgcctataggattgactcaggtgctaaggcaaattccttaaacatactggggtgcagaatggtttgtatcagtatggatatgcacacaatccaccaaaaaatggctgattacaggatcggtgaggcattcataggctttatgtttttcttttcttttcttttctgagacggtgtctccttctctcgcccaggctggagtgcagtggcgtcatctcagctcactacaacctccgcctcccaggttcaagcgattctcctgcctcagcctccccagtagctgggattacaggtgcctgctaccacacccggctaatttttgaatttttggtagagatggggtttcaccatgctggccaggctggtcctgaactcctggacttcaggtgatccgcccgcctcagcctcccaaagtgctgggtttacaggcgtgcaccaccatgcccagcccacaggctttaagtcctggcaacagctactcttgactggttggcagcatcaccgtgagcactatgagcagttaagaggaaaattctctctgcagtcagatcacatcctatgtaatggacctttactctacagcagggatctgcaacccccagtaccagtccagggcctgttaagaaccaggccaaatagcaggaggtgagtggtggggggagccagcgagc

SEQ ID NO: 3091 - DNA, 4314 bp, Homo sapiens
ggagtgagtgttgagttataattacgatttatttcttcctttaatgtggaattgtacttaagcaactgttctggaactatgaatttccaagaaaccaatgggatagagggactttctcagaaccagaagacaataaaagaatttgtgtatgtgggttctcatcagatggagtagttgaccagttggttctttcatagttgggactctggatgccgggcccatgagccccagtcttattgttttaatgatagaggaagtcccccaagactcttttcttcaaccaaagtagctttccacacaactctctccttaacaccttagctacttaaccagctactcaagacaggtgctattacctggcttcgacagataaattgcagctcagaggagaaaaatgatccacccagggttgccagctagtcgactgcagacctaggcctcagaactattccatctgagccccgattcccaaacagtcacacagttggctcggctgagcactcaagaagctgtgagtcaaccagcatgaagcatccctgctttcatctccgttctcccctgagctcagggagcagggctttcctcctcagacagtcacactgatcatttcctcttccctgtctttcctgcttggtgagtcatctaataacaacagtcttagtgaataggctagtgtttacaacctgctttattccagcagaacagatttcagggtgaaaataccatacaaacaggcaaaccattggtacctggcttagatctagagtcctctcggaaagtcactagcattcatctgacatttatgctcagttcctactttgttttttttttctccagctgaccatgcacatctttattgacccagaaagatccgttttgtgggggtgaagatgcgactctgcagttgcaggtttaaacaacccctcaaaacctcagggctggtcacttgcttctctggcttggcttctggtcagagcctgcagaccccttaccctgcattaaagcactacggttaggcctagaccctttggtctcatctcttagtttcgtcacagtcattctctcttgtttgttttctgtgagtcttggcctttacttttgttctggcttctctttaacctgtgaatcagcctctgtcctcccttttcttaggtggtgtcgcactccctggccttcactcactgctagtcacctctgcaattaggtgggcttggatttctcattttcttcctctataagtgggcatagcacacagtatcgtggggaatgaaatgagttaacattaaaattatctgtcacttagtagtcatttgactgatagattttttttttttttgctttgccactaaagaaagttaaagttaagaagttgagtgactggcataggatatggtagagcagggatcctcaatgatgagcaatttgccccccctccaggagatatttggcaatgtcaagagacatttttggttgttgcaattggagggaaggtacttttgggtatctagtgggtagagactagggatgctgccaagtatcctgtaatactcaggacaaccccatacaacaaagagtcatctgactgcacatgtcaatactgggcaagtttcaagtctctactatggatgatcaactgtatattttgggctctgaggcatatatgactactgttttgaccttgtaatattaacatctgtatatcaacaacaaaatcagtgttaatatcaatatcagtattaatgtactagccaaaagtttattaaatacttattatttgccatgaaaatacatcaataggtaaataatcacaataaaatcttttacatagttacttttatttatttatttttttacatagagtagaaacaagttcagaaaggttaggtgactatcccaagtcatagatagtagagtatgaacccctgtctaactgaggcccttaaatattactctgttctacctttcactgtattatgttgtctctcaatttttgatgtgagtagaaagaagtttgggacaaagcaatcagcaggaggctgtctaggacttccaggagcatgttagaagtaccagctgctggctgggcacagtggctcatgcctgtaatttcagcactttgggaggtcaatgcgggcagatcgcctgagctcagtagtttgagaccagcctggccaacatggtgaaatcctgtctctactaaaatacaaaatattagctggacgtggtggcttgtgcctgtaaccccagctactcggggggctgaggtggaagaattgctggaacctgggaggcggaggttgcagtgagccgagattgtgccactgcactccagtctgggtgacagagtgagactccgtctcaaaaacaaacaaacagacaaaaaaccaaaatgaaaaacaaacaaacaaacaaacaagtaccagctgctatgggatttggaaaatcagggtaatcaaaccctctcttacttactggtgaattctggcctctactaatggatttcacccctctcaagggctgttggggactctctggtgtgggagtgagttggagatccctgggttgctgtattaaatccaacaagggggtgtttctctggacagctactgtcaggggtcaagaaggaatggaggaagggtagaaaccgctgagacagaacaaagcctgttattaacagattctctctttttttctggtgagggtgatagttccgtgagcctcctatgcaggcatgaatacagtggtgggaagcacagaactctgggctccttaattgaaaggagatggaggtgggggacagggcacagatagttccttcccagaagttgctgactctctaacgaggcatttacgagaagcgaaatcttcctgcttgtagtttttcatgggatgacttccgtggcaaagaagtcacatatggagcagcggcctctgttcattgtgcaaaggcctctgaccatctggaccacccaggggctagagttttcctacggagggcaggataaaggagaagggattgacacctcggccccaaggtaattaccagatggcaaagtgcttgttttcactggatgattcagagcaaccgagtcaccccgggaaagccaatctgatttcgtcttcagaatcaagcttttccccttctaagatgtgttcttctctttccctttgactggcagcagtgaagtctgcctcttaggagctgagagagtgttgtctggttcagaaacaccgacagtatgggtcagcatttgctccctccctagcgtggccaggaattctgaggtccggtgtgcctgtacccactgagggagaagcgttccacgtgcgagaagtgagtgagagttcgttgctgtttaattgggaacagcccacttcttgaccctgacgtgctcctcattagagacacaggacatactgctctgaatgtttgaagaggacctcacagacacaggtattgtattaaacaaagggttgaatttttttccccttttagtctcactttcttgctttttctctgtttctatctgatatggtttggctctgtgtccccacccaatctctcctcttgaattgtaacccccacgtgttgagggggggacctggtgggaggtgattggatcatgggagtcttttcccccatgctgttctcgtgatagtgagtgagttctcatgagatctgatggtttaaacgtgtttggcagcttccccctcgctcactctctcctgacatcttgtgaagatggtgcttgcttttcctttgtcttctgccatgattgtaagcttcctgaggcctccccagccatgtggaactgtgagtcaattaaacttcttttctttataaattacccagtctcaggtagttctttatagcagtgcgatggactaatacactatccaaaggcagatgtgtggaatctaatggaatgagaggccatgcagggctgttgggagaaagatatcgacacctccccattctccttccctatgtcacttgtgttcatggtactcactgagctttgtcctcaggctggagtgtgaggctcagccatggcctgggagcagagctcagtgactgtgctgtccagtggattgggcctgtcaccctggactcctcaaaactgtgcttgcttattcatttgacaaacattcattcaagcacattcactgttatgccagacatgttggtagttggagattaaattattgaaagaatttttttctagcattaaagaactcacagttttgtgggagaaaggcatagtgagtaagaaataattagggtgctgggagttgaacaaggagaacacatgg

SEQ ID NO: 3092 - DNA, 7002 bp, Homo sapiens
aatgtcagtgcccgcccctgcttacaggctggggccatctgtaggcttggacaggaggggtttggggagacatggcctgctgtctgggaaaatattgataacatgttcccaggatgaggcatttctgacccttgttgtggtggaacgtggtgttccttgtactttctcccagcagaatatgataagaggcaggctatttctcatggcctgaatccctgtggaatatttcactttaagcacggtctgtgaaatggcgggggacttacaaaatggtgcagattggactttcttgccttctactttaatataaaaggaagaggggcgttgttgattatctggctgtttcctgtcgaattaggggcactgtaaccagggtttgggttttgaagtagtgggtgttcgactttagagttgttttcctggaagcgctgatactggacttagtggaggagaacgacggtatcaatgtgtttctggatgactgcctggacaagggagttcagcttttgggagactgactgggctatgaaggatggtagaggacagtcttcagcctgagacccatccctagttatatcttctggacagattcctagaagtgggattactggctcaaaagtgtacctttctactctgcagaggctggaaaggcaaaaatgatggctaaggcttccttgcagactgagaacccctggagaatacgaaatggtctttcccatcagacaggaaactcccagcatctcatactcctgtctctccacatcccacgccagaaagatgcaagaaacttcagtttaaaaccaatgcggagttcccagacacagaagatgagcagggacatcctctgagaggaaaactctggtggcttcaggggaatcaaagcaagtccccacttctgtcctctcctgagctgaaaactcagagcaggctgggtgtggcagctcatgcctgtaatcctagcactttgggaggccaaagtgggaggatcagttgagctcaggagtttcagaccagcctgggcaacatagggaaacctcgttaagtattaaaacaaacaaacaaacaaaccaccaaaattcagaggggacaggggaggtggcacactgctgtccttctttttcccctaccatgtagcacagggcctgtggaatggaaggggcgctgtcaatgtgtgttgggtgatggactggatgaataaatggtacatctgtgtgcctagggggcccattccagacaccaggtagtaaggcagccagatgagttctaggcctggccttcgagagactctgagatgatggacaagctgcttgtctgggccccagtcaactcaccactggacagatctctgagagatctgtggccccaagtttctagagcccaggctttactactgagaagatccatggacgtggggaagcacctactcatagtccctcagagagtctgtgtttggtttacattgaagccaggcatagtgccatgtgcctgtagttctagctactctggagggtgaggtgggaggatgggagcccgggagttcaaggctgcagtgagctatgatcacgccactgtactctagcccaggcaacagagtgagaccacctccctaaaaaaataaaaatgaagatgaaaatgaaaaaaaccaaaagagtttgattttctcacaacaaataggtgccctggttagtgatggctgcccattccatcattttttcagtcgactttctgagtctatcaaactgcagtaaattctcctttggcctcaggatggagccaggatcttctccagtcaaatgtctctgaggccagctggggtcagtggaaactgtggggagagggatggggaagagcaggttctatctttgctcacatcctggagttgtttctgacctgcccaggagaggctgcccctccagaactagactcttccttggctttaagatgtgaagtcgagcagctggaaggacagacacctcatctgaccactgttctatggaccaaaggcaggatgagcatggtaggtgcagaggctgcagttggaaacttgaaacccttgcctgggaaatgaagagcaaggccctgatttggaatgaatatgtttaaaataaaaataattacacagagttggaggagctcttaacacagatggagctcaatcatcccaatgtattgatggagaaacaggctcagcaagttcatggcagaaatggggctccaatcctctgtgaggctttgcccggtgccctagctatcagggaacacgaaatctgtccagtgcaaccaccttctctcatcatgtttgccacctgcttaagactctccttcaagtaagcaagtaagcagcatgttcttactgaccacaaagtagccattgttggggcaactctggcagtgaccttgatcgcctctagaatgcaaaatgcacttgacttatgcaaataccaacacttagtggccctttgactgccagggagcattatggacctttcgctgagtttcacttggacatatgaacttctgatctcaactgactcatttagttggagcagggaatcccaatgcctttggaaatagaaaatggatatgactcaggatgaaacatcagtggaaacagacctttcaagattttttaaaaaaatataactactggttagcatagtcataaaattagatagttcttcttccttatttagaaaacagaatacagaccgggtgtggtggctcatgcctataatcccagcactttgggaggctgaggcaggcagatgatttgaggtcaggagttcaagaccagcctgaccaacatggtgaaatcctgtctctactaaaaatacaaaaaattagctgggcatggtggtgcatacctgtagtcccagctacatgggaggctgaggtggcaggatcgcttgaacctgggaggcggaggttgcagtgagctgagatcatgccactgtactttagcctgggtgacagagcgagactccatctcaaaaaaggaaaaaaaaaaaaaaggaaacagaatacaaggtcaggcatggtaactcacacctgtaatcccagcactttgggaggccaaggtgggaggattgtttgaggccaggagttcgaggccagcctggccaacatagtaagaccctgtatctacaataaaagaaaaagaaagaaaacagagtacaaagggtggagtctgggtctccagtcttgtttgtctgcttgtaggtcctgctattccaagtgtggaccatgtaccagctccatgggaatcaccagggagcttgttaaaaatgtaaaaatctcaggctttcccccagacctggtagatcacaacctgtatcttagcaagatcccccagttgacttgtagacacaggaaaatttgagatgtactgcctgagagcaccaaaacatgtcaaacacaaaatagacctgaaacaaaggaagaaaataaagtatttaccatgcttgcattgtaatgagaatgcacgcaataacttcaggacatttatgacaataggaattctttttaaattagtagatggttctttttagaacagctttagatttacataagaattgtatagagttcccatataccgcccccttatcccaacatatacagattttcctcttattaacatcatgaattagtgtggcacacttgttaaaattgactcaatattgatatattattattaaagcccatagtatacattaaggttcacctttgtgatgtgcagttctatgggttttgacaaatgcataatgtcatgtatccaccatcaccatatcctacagaacagtttcactgccctgaaaattctctgtgctctgcctgttcatccctctgtcctcccaaacccctggcaaccactgatctttctactgtctccatagttttaattattccagaatgtcatatagctggagttatacagtatatatccttttcagattgaattaatttatgcctttatgttcctccatgtctttttgtgatttgatagcttatttctttttgatagcttatttcttatactattgctaaatagcatcccattgtatggctgtatcagagtttgtttatacattcatctattgaaaactcttttggttgcatccattttgggaaaatgatgaataaggctgctgtaaacatttgtgtgcaggtttttgagtgaccataagttttcagctctgttgggtaaatacttaggagtacaattgctggattgaatggtaacactatatttagctttgtaagaaactgtcaaattggagcagggtgtggtggcatgtacctgtagtcccagctactcaggaggctgaggcaggagggatttcttgggccgaggagtttgagactggagtatgctataatcacacttgtgaatagccactgcacagatgcacaaaagaaactgtcaaactgtcttccaaagtggccgtgccattttgaatttccactggcattgaatgagagtccctgttccacatccttggcagcatttgtggtgttaacgttttggattttagccatcctcgtaggtatgtcatagttattttgatttgcaatttctaatgacatatgatattgaatgtgttttcatatgcttaactgtcatctgtatgtcttctttggtgaagtgtctgttcagatcttttgctcattttttaattgagttattcattttcttatttttgagttttaggagttcactgtatattttggacacaagtcctttatcagatatgtgttttggaagcatttctcttagtctgtgacttttgtattgttcacaaagcaggagtttcatattttaataaagtccaacttaacatttcttttcccagctccacattcagtggtatcatgttggtaacttgggatcagccatattgggggtatttacactgaagaaattggcagactctacaaatcagggatttccaccttccttacaagagttgattgttaaaccattttatagcacacgactgcctcctatgaactttctattgaatcattccagttggtctattactttagttataactttttttatgtaccagagaagctttttgttttgtgtacatatgtaagatattggtattttatttttcttttgatttaatttctcttggcaaggcatggtagctcatgcctataattctaggactttgggaggcagaggcaggaggactgcttgaggccaggagttccaaaacagccagagcaacatagcaagacctcatctctaaaaagaaaaaaaaattagtcagctgtggtgacatgtgcctgtagtccgagctacttgggaggcttgggtggcaggatcttttgagctgagtagttcgagatggtagtgagccattatcacaccactgcattccagcctgagtgacagagtgagaccttgtcttttttttctgagacagggtcacactctgtcacccaggctgcagtgcagtagcacaatcatggctcactgcagcctctgcctgtgaggctcaagcgatcctcccaccttagcctcccaagtagctggactacacgtgcacaccaccatgcccaagtactttttgaattttgggtagagatggagtctccctatgttgcccaggctagtctccgagtcctgggctcaagtgatcccacctcagtctcccaaagtactgaagtactgagattacaggtgtgagccatctcatccagcaagaccctatctcttggaaaaaaagaataaccaaaatatgtctaaagaagagagaagagggattttccttagtatatatgaagacttaaaaaaaattacagtaattaggccaggtttggtggctcacgcctgtaattccagcactttgggaggccgaggcgggcagcttgcctgagctcaggagttcgagaccagcttgggcaacacggtgaaactctgtctttacaaaaatacaaaaaattagccaggtgtggtggtgtacacttgtagtcccagctactcaggaggctgaggcaggagaattccttgaacctgggaggcagaggttgcagtgagctgagattgcactgctgcactccagcctgggcgacagagtgagactctgtctcaaacaaaaaaaaaaattatagtaattaggcagagtgatattagggcaagtgtagaaaaatagatcaaagcaacataagggaagcccagaaatagatctaagcataggtggaaacttacgtgataaagaaaacattaaaatcagaggggaggccgggcgcggtggctcatgcctgtaatcccaacactttgagaggctgaggcaggcggatctcctgaggtaaggagttcgtgaccagcctcgccaacatggtggaacctcatctctactaaaaatacaaaaattagccaggcatggtgacaggcccccgtaatcccagcttctccggaggctaaggcagcagaatcgcttgaacctgggagtggaggttgcagtgaaccaagatcgtgccattgcactccagcctgggcgacaagagcgagactccgtctcaaaaaaaataaataaaaaataaatacataaaaataaaataaaatcagaggggaaacactgggctgttcaacaaaaggtgctggaatcattgactttccttacgggtaaataaaactaaatttctgcctcatactacacatgaaaataaactccaaatgaattaaaggattaaagccctaagtgtaaaaccccgaaatttagaaccaataggagaaagatactgagaaaaatattgttaaactcatgttacagagaggcatgcaggactttgcaaacaaggtactaaacattactgattgataacttgtatggcatgaaagttaaaagtggtagttttttttttttttttttgagatgggatcttactctgttgcccaggctggagtgcaatggcacaatctctgctcactgtaacctccgcctcctgggttcaagcgattctcctgcctcagcctcctgagtagctggg

SEQ ID NO: 3093 - DNA, 8411 bp, Homo sapiens
ggaagaactctgtaaatagttgtagcagctactgttggtaaatgagtaagctacattccaaaatatctgcagtccttttttaagccccagtgttctaggattctgcctggagggaggatgcttaatttcagataatagctgcatcaggaccaacatgggccaatggggatttccaaagaaggatggtccaaagcacgctgggaaagttggcaggatttgccctaagcatcactgaagttgatgatatgatgagacacagctcatctggtctcaaactatctcccccagcagtcatggtacccaacattttgcaactagaaagaagcccatatctgctaactcaccaagactagaaaccattcttgatgtcactatgatgtacatcattttacctaagatttacttatctacctatatccatccatccatccatccatacatccatccatccatccatccatccatccaacatcaggaaccttctgaaggctaactgcaccatatggtggatatgatggatagattttagtcctctttcgttgttggcactccaaatttgggatgggaattgtcattgagcagctattctgtgctatctagacgctttagacacattatcccacttaatcctaatgacggcactaagagctatagataacaatgtttataaggtaataatagctacgatttattgagtgttactatgtactggccactgtgcttagccttttatatgagatatcacatttaatgtccccaacagttttgagaagaactcttatttctttgatttaccattattgcccagcttcagaaaggttaagtgactagcccaaggtcacacggcacattagaggtcaaagcaagcctctttccctggtctttgtaattccaggttggtcactgtctgcttcactgtgcctctagctaactgattttctcttggagggaggcatgcgggctcccaacctcactagacaatcatgggaggaggaaagacaagggctttctcacagagttaactctccactccttgccccctggggaagggcaccccctcctgagcatcctgacaggtcagcctgcactcaaagtagcctttcggggggcccttgatggctcccagatgggaacgcacacagctgtcaggtgcttccgagagtctctggatcctaagagcactggcggtgtgcctgtaggattaattgcttctctggcttccagcagggaagcggggtgtggtaacatcttggcttggttaaggatgaaggggcaggcacacaggtggcagagagcatgcctctgtagcacaggatcagaggaaactatgtggctgagaacagctcctggtaggtagggaagcccatgaggacctcacttcccctagaaggaagatgtcagaagctgatgtcctttccccctgtgcagttctaaaattatgtaactggaagaggtgccacaggaaaacctgtttctatcatccttattcgttctgtgtggtcttcctccttgtctttcttacaattcttcttccacagttaatttttttcaggcaccttctatatctcatgctctggaaataccaagatgaaccatgcagaccctgaccccatggagttgagagtctggtggtggaagacagacatcatcaaacgctggcacaaataaaggcacatttatttacttgaggggttacatgttaagtcacggaggcacagattctagaggagccagtagcagggcctgagcttggtccagggttggccaggaagctctttcctgcagaagtaatgcttgcactcaggaccaaaagatgaccaggtgaagagtcacctcactccttgaaacctcagtttccttctttgtaaagtgggatgatagtaacacctacattccaggatatttgtgaggataaactgagatgacacaggtgaaaatgagtagtacggagtctggtacatagtcagtgcccatcgtatcatggctttggccatagtccctcgatgtgaagtgaagttcccatagattggaaggcctatcgttgacttagaaactgctgcccaagggacaaagaagaatgcaagcccactatgtgaaatggaagcacacagaaaaggaagggcctcactctgctctctctcttctgtgtgtgtgtgtgtgtgtgtgtgtgtgtgtgtgtgtgtgtgtatgatgagaagtttgcacagagaagctggtgtttaggccaggtcctgaatggtagatagcagtttacaagagaaaagggggaggaagggtgtcagagataaaaggaacatcaatgcaaagtgatacaaggatgagaatgagtgtcatccgccttgtcagatgcctggggaaattccaatgggcacatggaacagatccccaaacaaaacaacctttaataacacaatactattactcctaatggcaataacggcaaaagcaataatcacaatgaccacaatagcaacagccgttaccatgcattgacaggttactctctttcaggcactgtacatgggtaacttcacctgaaatgctgaaaataaatcttgctcattctttcctgggatatagtgaatgacttcatgccctacattgtatgggctacccacataggtgaggaattgaggatacagccatggaggatttttctgttaaacctcagaagggatgctctcaatttctgcaaggctctcctgggcaacatgaacggtccagacaagttcattcatttttttgtttttctggagggttaaatgggggatagagtattcaggaggtaggtttagctcagtccaaggatggctacaaagagctgtggtaggtagtgctctgacaaagagttccctgtcgtggggatattcaagtgtaactcagttaatttcttgttggggatgttctgagcatggtcagaacaaagagaaagggaaattcagggggaattggtctagaagatcccttcaattccaggatgctgtggtttcaggaaggcaggaatgatctaccatgaaaggtttttacaacagtaggaaacatcatcatcttggctttgcctgtctccaggaggcttgaatgtgatttgcataaccacagggggatggatgtcttgatctttcacagtttttttccagcccttagaatcattctggtctttgcttgcaacctcctttagaaccatatcctgagccacctccatccttctcccaaattattgtaacaacttctgagtaggtcccctagcactctataatctaccctccacacagaagcaaaagctatcatataaaataaaaatcggatatattttccccctacagttgtaacttatgaccatagccgtccccaacccaactggttctcccattccacctcccctcacctaatgtgcacaaaccactctcccttcttttctgactcacaaacattcagggcttttgcctttcctctgtctgagccctcttcccctaggactttgcaaggccagtttttttctcatcgttaaattcccagctcaactgtcaccccagacagggctctctgaccagtctccagtcactccatccggacgacccttttaattttcctttcagcatttatctagctgggcctggtgatgtgtgtctgtagtttcagccactcgggaggctgaggaaggaggattgctggagcccaggagttcaaggctgcagtgagctgtgatcatcactttgctccagtctggatgacagagcgagaccctgtctctaaaacataaataaataggccaggtttggtggctcatgcctgtaatcccagcacttttggaggctgaagccagtggattgtttgagcccaggaatttgagaccagcctggacaacaggtgaaaccctgtttctaggaaaagcaaaaattagccaggcatagtggtacatacctgtggtcccagatactcaggaggctgatgtgaaaggaccacctgagcctgggaagttgaggctgcagtgagctgagactgctccactgaactctagcctgggcggcagagtgagaccctgtctctaaatacataaataaaataagtaaagcacttttcagtatctttctggaattcttatctatttgttaacatatgtatggtctttttctgctgctgagaggtgaagccagctggacttcctggctcgagtagggacttggagaacttttctgtctagttagaggtttgtaaatgcaccaatcagcgctttgtgtctagccaaaggattgtaaatgcaccaatcagcaactctgtaaaatggaccaatcagcactctgtaaaatggaccaatcagcactctgtaaaattgaccaatcagcaggatgtgggaggggacaaataaggaaataaaagctgaccaccccagccagcgggggcgacgtggtggggtccatttgtaggttgtggaggatttgatcttttgctcttggaaataaatcttgctgctgcgcgcgctctctctctgggtgcatgctgcttttaagagctgtgatactcaccaggaaggtccgtggtttcattctggaagtcagcgagaccaagaacccaccagaaggaaccaactacagacacactgctatatggtccagctatgtacaaactgaatcaagattctatgtacatcagaatcaagagagagtgagttcttgacatcacggagcggtctacattctagttcatgcggtggacctgctgggtggcctcaggtaagagactcatttcccttatctataaattgagaatcctaactctttcccctaatcaaacccagctggtaaattcccccttcaccgctcccttctcccctcaaagagacaagccgtctttgccatatgcctctttcttttttccacccagaggtacctttcaaatgctggcccagaaaggtgaggcaaggaggggacctggcctccatctctgtgaatcccacagccctcctcctgagatctgcaggggtagcatgaaatatttaaaagctcaaattgaaatcttgttagagccaggtcttgtaaagccaagttctccaaccccagaacatcagtatctgtttgctggtgtcatttagggaccccggctttccaaaccattgactgaaactttctgtcaatccaacacttttagggtaatttaacttaataatacctttgtcggcactggcgcctgtatctgaagggtgattaccatagaagttattttaggttgtttaatggaatgtagtaaattctcaattgacagggcagatcctcaaaatggcttttcaaagtgtttacctttcaaagctttctccctcactttaccgaacttactactttgagccagcgaagacttcataaattattagcaattgttctcccccctgtgttcacatgcatcattaattctttgtaaaaagttcaaactgtccggggcttaattgttatcacttggagaacggctagaaatggatgcaggctgtattatttctgtcaaaaattttgacttattgctcttgatattttacccatcacatcacatcctcggtacaggagagaggaaaaaggagagggggaggagaaagaacataaatgcgttttcttgaaacaaaacaaatataataatacatatatttctgaggagaaaagtcaaggattcatctgacaaaataatagttttaatcctccaaagagagaggaggagggcagcattagggggaaatttctattgtaaattctattgcttcacactgtacttttattctaagttttgaaggttgtataattctaggaatctaatgtttaacgattctgagatattgaaattttatgagtccaaattcccaaggtgtttgattttaaggataaattaatcccaccgtccagtattcaggactgctaaaaagtatagtagaattagaaagatattgacaataaccacagaaatagctaagctttgttgagaccttaaccatatgcaggcactgtgctgagtgcttcatgtgcagcaccttattttattttattttattttattttatttttttgcttttgctaattttttaaaattgtactttaagttctggggtacatgtgcagaacgcgcaggtttgttacataggtatacacatgccagggtggtttgctgcacccatcaacctgtcatctacattaggtatttctcctaatgctgtccctcccctagcccctcatcccccaacaggccccagtgtgtgatgttcccctccctgtgtccatgtattctctttgttcaatgcccacttatgagtgagaacatgcggtgtttggttttctgttcttgtgttagtttgttgagaatgattgtttccaggttcatccatgtccctgtgatcccattactgggtatgtgtccaaaagattataaatcattctactataaagacacatgcacacgtatgtttattgcagcactgttcacagtagcaaagacttggaaccaacccaaatgcccatcaatgatagactggataaagaaaatgtggcacatatacatgatggaatactatgtagcagcaccttatttaatcttcatgtcactgtaaagtaggtactgttattaaccccttatatagctgggaaaactgaggcacagagagggtaagtaacttactcagggacacacagctggtaaaaagcagagttaaactctgacttcaggccctgtgtgtgtagaacttaacgtatattgtgccccatctcaagacactgctcttttgccccacctggcatgctgtggatcagtgtagaagtgatccacattggtatatgagtctattgtcagactacccctgaggcaacccagccctgacctgctttttgtttgtgttgacgttgctcatccagtccagcagatcaccctttcccatacattctacaaggtcatctcctccaagaaggcttcagtcctgccgcaccatcctttgaatcctcacaacagttggtaccagggaaagggataatgaggcagtctagtaggctggccaaaagcatggactatggggtcagatcccttcggttgggatcttacttctgccagtaaatccatgcgctaagcttcagttaggcaagccatttcagcctcagctttcacatctgtaaaatggatataaccacccctgcctcacagaactgttgtgaagaggaagggaggtgctccaagggagctctgtttactgcttcacaacagtcagtgctgaatacatgttggctgttgttctctcttgtcttgtagtgatctcgtactgagagttttgtacattaaagtataagagtcagtattttttttcctagtcaacatttattttcaatgagatttggaaatttccttaccaaataattcaaggtgaaagtatattaaactatatttttaaaaattgtatttttgacaagtgaccattatatatatttatgaggtacaatgagatgttttgattatgtttatcttgtgcaatgattaaatcaagctaattaacacatcacctcatttacttatcattttttgtggtgaaagcatttaaaatcttgtttttttagcaattttgaaattatatattgcattattgtttattattgtcatcattctgtacaataggtcactgaagcttattccttctgtcagctgaaactttgtaccctttgatcactctctcctctttctctacccacctgcttcccccagcctctggtaaccaccattctacgctctcaacttctttagatttcacatataactgagatcatgcagtgtgtgtctttctgtgtctggcttatttcacttggcctaatgttctccaggttcactgaagcaaatgacaggatttccctcattgtaaaggctaagttgtattccattgtgtacatacaccacatttttttaatccattcatctgatgttggacattaaggttgcttccatatcttaactattgtgaattacatttcaatgaacataggagtggaaatatctcttgggcataggatttcaattcctttggatatacaccccacatggtaatcctatttttagttttctgaggaactcccatactgttttccataatggctgtattaatttactttcccaccaacagtgcacaagggttcactttttccatacccacatcaacttattatgtctttttgataatagtattctaacaagttgtgatgatatatcattgtggttttaatttgcatttccctgatgattagcgatgaccagcactttttaattcctcatttgtccattcgtagatcttcttctgagaagtgtctatttaggtccttagctaattttttgattgggttatttattttcttgttattgagttgtgtttcttatatattttttatgttagctccttatctgatgta

SEQ ID NO: 3094 - DNA, 2810 bp, Homo sapiens
ctagatcctgaccatcctactaatcattagtaccagaaacatcaggatcaatcatcacatttgcaaactaaaaacagtgaaggtggaaattgcaaatcacttccaatccaatagcatgccgtccatggtaatagaaatgaaccacgacaggactggtttacagtagttgagaagacaaattttcagaagcaaatattggcctaaagaaacttccaggaattaggggttctccaaaataatttgtattcaagggtgatatgatttttaaaagttatttgtttgaacaaggagcatttccatttggaaaaaatattcaaacaacacaggaagtacccagtgaaaagaagcctccattacagcactgctccccagagccgggtctccttcctctgaggcaacaactgttactagtatttttgcttatttatctagagatactctatgtatatctcccttttataaacaaatggcagcttgtgatgcatggtgctttttgccttgttttttctgtaggacataattccatacctgtatatacagatctgccttgctctctttggtggcttcagaatacttcattgcaagtgtcccctaactttttgaaccagtcttctaccaatggatatttaggttgtttctaatcttcagcaattaaaacagtgatgaaaggaatatccttttatcatctttacatatgtaagtatatctataggagaaatttctagatgtgtgattgatgggtgaaagggcatatatgtattcacaactttgatagagattagaaatattcctttaaagatgttgaattaatttttactcccataaaacatatatgagagtgcttgtttctcccaaccacttgtcaaattatcatttggtcctttccctaaaatgggaaatgcctttaatgatttttaagctatctgttttgccccaacttcttgcttgctcaggaatcagaaggtttctagattctgctcttatggctactcagagagatttaagaatatcttagttctctctttggcaactgacctaacttttatgcaacaaagaagggagaagagagttaacattcattggatggtctcaaatgtttggtattcatttagctaatacttgttgaacacctactctgtgggctctgttttaggttctaggcatttatcagagaacaatgcggacatagactcctgacctctaggaccttacattctagcaggggaatgagacattaaaaaatatgataaacactcaaattagaaggtggtaaatgtggaaatacaaaaaaagtagaataatataatggagattagaagaacaagaggcaaataaatttaggggattaggtaggatggccagggtgatcctcattgagaaggtaatacttgattaaggacttgatggtgttgggaagtcagccaagagatagctgagagaagagccttccatgcagagattataggcagaatgaaagctcgaaggtgagtgtgtgcttgaggcttccagtgtgactggtgtgagtgggagtgagggagggagagagagaaagggagaaaaggagatagagatttgataaagccttacagggcattcattcagtgaggctgaaatgcagcagtactgcaaggttttgagcacaataaagacaatgatctgatacatgtttcaaaaagtaaagacttttcttttttgagacagagtctcactctgttgtctaggctggagtatagtggcatgatctcagctcactgcatcctctgcctctcgggttcaaggaattctcctgcctcatcctccacgtagctgggattacagataaactcagatccctctactttccaagtgtgagaagattttgttctacagtcgcttctgtgagatcaccacagccctggcaaaccaagagggaggaaccttgtgcctttgaagtgtgattcacagtgcttgataaagtgccagtattctctaaattttaggttcacagcaaattggatggaagttacagaaattcttctatttttaattttaaactaacatacgacaaaaggatttcctgatttatccaccatttcaaaaaaaggtccgaagaaaatgaaggagcctcttcctgtactcatggtacataaggccttcaggagcttccggattaacaccttgtattcccagaacttgttgacaatgggttcatggaggagaaacctgatgtcttcgataaggtaacagaaaccacagaaatcaaaaccgtggataagaggagactacagaaagatttctccttctggagtacatgaatcaaattgcattgaatcaaaagttttgtgaagatttgagatgagaatgagagccaaataagccatatcataagaagctgtgatcagaaataaaatgaggacaatgcttactgtggctttcaaggcaggagaaagcacacccgagggggtcgtgtcccacactaggcagatctaatggtgccacaaaagacaggtgttttgtcagatttcagccacacactttcacacctgcaacgcattaactaccgcagcaatgttaatgaagaccaggtgcctgttctccagcataaatgaggaactggcaggagatttgctgtttgctacctgacgtctacccctgagtctctgaaccccgtccttctggttgaaggggaaggtgtagtgatgtacaaaaaatgattcctgttggacattcaacacgatactccaatgtactttgaacacgtcatgttctgtgaaggtaaaaatgtgacatcaaggcagagaagacatcttgcttaacattttggattcaag

SEQ ID NO: 3095 - DNA, 2394 bp, Homo sapiens
ggatgtgctgggcctgaccagccgcccgctttcctcttctcttgcctctgcctgccccctggtggacagctggggtaaagcatgggagtgcgcctttggggtctcagtggggctgaaatacgactcctcccctaggacagcctgccttccccagccttgttctccggcaaagtcaatttcctggagaatcgaggctctgcctcagatgttcggagcctccgcaggatgaacacctccatttcaattccaggggctttgatcaacctgtgcctcccttgatccccaacttgtgggcaccttcccttgagcagtgcccccacgaggtacacctttcccgggaaacaaaaatcattccttctttgggtcctgcaagctgtaaagaaccaatacagcactgtgctactgaacatgttgccactatagaagccccttgtgttttgaagagtacatctctatagccattcgtttattcatcagaaaccagctagaagccaggccctgtgctgggcgctggagacatggaagaaactgggctgaggctcccgccttgaagagcttgtggcccagggaagggacagttcatctgtcattgattgccacgtgacagtgtctatgatgctaaaaagatgccagtgctgtgctgcaggagcaaaggccgtggaggaagaggctttggctttgttgcgagtccttgccagagccaggcaaagccagtcaccgctttgttcagatgactcaggtaaataaatgaggccgcacaggctgtcctgacaccacacacctctagaataccctggctgtgctgggagctattggtgtcagctgagtattttcatccctgtccaagtcacaatgatctgactgtaccagcctgtgtggatgttgctaagaggaggcagacagcaccatgagctcccttagatgacgatcggcatgatgttcctgctgtggcagcgctcagctcttgccaatgctcttctctgctttgctcactttaagcctcccttaatttttttgaagcccagtttccacattgctgattcacagatatgcaagactcaggcaggaaaaaaaaaagtgtctccttttccagacttcttagaggacttggaaagaaaatgaaatgacgttgaacgaaatcaaagtaaattgagtgatctgaaacgatttgatgtcagcaagaattccccatacagctcacagccctaccccgagcacgcctccctcttgggtatggtgagttcagctccaaatttattctgacaagaaagcacaggcaatggcttcagtgggtctaaatcaggtgaaaattcaaagcaatcacccttcctggacaatcttctgctttctcagtgcttatcatggtctgaaaattcctatttaaagaagcagagctttcttttaagtcctaacagaacaaagtcacactcaacagtgcacaggcacacgccgggatcgagaatgcatttttggcaaaaagtctcctcttttctctgtctcctccagctctctgcaggcccaaaccttgcagaagccattccatgtttcctgagcaggaaaagacaaactcagaccgacaaccttggacttcaaaagactgcacacaaggggaggaaggactgagagtaccaaggcgtgagaattcagaatgctgctatctcatttatttttaccatttaggaaacgttttgatctgcattccttttcccttccctgatttcaaaaaataaaaataaaaatgcttcggttctgaggagtaactctccagatggaaggggaagatcaggggatgaatgggggagggctgcttgcgtcctctcccctgccacacacacgctctctgtttcagccagtgtaaaaatagccgcccaggtttatgtattcatccctaagctgcaatgaagcgcctgcctcccggccagagtccgctgccttttagtagcttataacatcaggtgacgcctccagccctcccattccccgccccagcccggataaacgtcctccgtgaccttagaagttttcagtttaatcagcggtatcgtttttgagaggaaaatcctcccagctttgcgggctggcagggctctggggccctcccctgcctcccagcccaggccgcagagcgagagcgtttccatctgtgctgcgagcgggaagagcctctctgtgctccccggcacgtccagcgcgcgggcgggaacacgctctcctgtggggggcagctttcccagggaccttgcctaacgagggccaggcggctcccccgtgggccccgaatggctcctggcaggcagacccctatccctgtcgagagcactgatttccccagcgtcgggggaggcagccgcgccctcctggagcgaggcaatccagcggtcaggcggcggcgag

SEQ ID NO: 3096 - DNA, 3884 bp, Homo sapiens
acgtttaaatggcaattttatatattgctttcttatagaataatcttagtgttcctaatatatttttaatttgatattcttgggttttgttaggtgtaatcacatcacctaagattggtgataaatatgtctgattctggcttcccatttctgcaactctttttctttctcttatctgattgcattatctagtacctccagagcagtatcaaattatggcacatttttattatgttcttcattataatgagaacaattcttatttccccattaaatgtgatggtggcatttgactttgtgtgtattggtacaaataaaccagatatttttattatcaggagttttttattattaatattagacgagctctgtgtgccattttgcgttaaaggagtatagatttatagaaacatttatttcttaaatagctataagctactttctttgcttgattgaagctgggcatttttgctgttcttttgcttataattaggtctgtaggaaggaagattttgtaatcatgcttcattttgccatctgaaaggaaaagtctggtgggaatattttaattattcatcatggaatctctgtatagcaaatcaaatagagttatgtattttttacttgatgattttgctaatgtggttctaatactcacaacttaagcaaccaaaaacaaccaataatattttaaaacaacataattaattattgcttgaaagtttctaccaaggggcatatggacttctatgagatccaattataaaccaggaaaaagagagatcaacacttgtattttaacacatatgcagtttcttattagcaaaatttcactgataaacatatgctaagttattatagatgtgagccaaaagttctttagaagtaggtatattctgcatttgaactctacagcatttgaaatcacattggctgacacgaattagtattagatctggaaactttgccagtaattcttctagtctccaggaaaagtgaaagcctttcattttggttttctttttggtttgttggttttgctttcatttctgatttttgtttggtggtaggtgcttttatgaaatacttttttaaattacccttactatttattgattaattgttggtaattattaattatctacctttcttagtgtttttcttcaaactctgcaattaggaatacccacatattggaacatttgctactctatctcattccacatgtgtgtgtatggtgtatatatgtgtttacatatttgtgtatattaatttccacaagtattttatgcccataaatattcatgccataatagacttttgttcatttatgatgcaaaaattaactctgaagcaaactgtattcttgcttctcatggtcacatactttctctctctgtctctaagctttgttaacctagtggtaaattctgtggtacccatttgcatgcacacacacaagtatgtatacatggaatagcaagtctctaggggctttgctgaagttaaaccaagaatttcaatatatgatactactactaaacagtatcaggccctgcgaacatgacacattcattgccaacatcaggacacctaatagagtggatactgaccaagggggtgtattcttgcccagatgatacttatttaggcaatgccagtgttggctaatttcacttttccttcatggcctctgtctctctgttacttatgtagcactcattctgtgtcagactgtgttctaagaacttcaactatattaaccttacttaactgttaaaaagacttctgagatagataccatttatccatttcattttcaggtgggaaattgaggcataaggcatttgggcaatgtgttcaatgacaattaaacagctagaaagtgcctggttagctaggatgtaagccaggcattttggttcctgagcccacactcttatacactgtaatactatctcattcatcctgctgtaattattcatttaattacatgagctcctgccagactgcatgttctatgaataaggggccatgtcaatcttgcctgtctttctatcttgtgtcatcataatgcctggtaggtaatagggaatacataactggttttcacttttaattgaattaaagtaaaagtttgtctctataagatcccttttcatatatcttcctgataaaaaacctgtttaataagctgaaaagatgaggtttcattaagaagaggtgatacagaaaaacaacaccatatttttctaacttatgcctcatctggcttactgcttagttcccatttgtcatcagtgcacttaaaaaattattttgaaaaattgccatttttaatatctttggaacttcctaacacattacctattttttaaccaaacgaggtgattccttatgggaaaatatatacagcaagaaaaaaaaaaggaaaaaatgttgatgatacctgtttaattgggaaatatgtttgcatatttattatatctcggaaagaaatgtatgacttattataacagcatttagtcttccaaaatatcagtgactccacagtatatgccttcatttccaaaatgaggggaaaagcattgagtgtatagtacttcctttttttcccccacaaagaaaaaatcatagtggaaattacattgaagaataatctgcacaaaacaaaaaagcacaaatcttatgtttctggttcagtgacttttgataaaggtaacccataattactaacccaatcaagatacagaaccattctgtacctctggaaagttcccatagtctccctcccagtgaatcttccctagtcaccccttggtaaccattgataggatatctatcgcaataacttaattctgcccattcaagaacctcattttaaaccttacaaaaccagaagttattgaaagagatgtgattgtaaccatctttgtttttgtaaggaccacgagttaactacacgtagatatatcatccagagaaaagtcctgataaaagtataatcagtgcaagttgaattcacaggtaaggtttactgtagacgtggaagggtgtttcaaaattactcttgagaaacaggtctcaggctaacagtttctctcacctctgttgcattgtctctttcttttgaataactactgtgtgctgtggtttcacaaacctctcagtaaagtagtgatgggaaaatacttttgttctatgttttgttgacctagtggtaaattctgttacccagctgtcaagcaattagattataataatgaatattttcttaaggcaatttattgggccaaagaaccctgtgaataaatagtagtatcttttattttcagagagcctagttaacatccctccacttgctaaaactagccagaatgtgatattagtgactttcattctattaaataagcattcatgattatcctaaacattcttgccaaatgtgcatatgaaaatagcatagccactgtaattgttaagtcagtcaatttttctcaaggactgtgttgctttaaaaagttagtagtgtttacacattcatgtgattggtctgaagtttacatgctaaataatatttactgtgaaagatgtgtgtgtttgtcagtggatgtgtgcatatattcagatacctaatatgaccaatgtgacaagggaccccatttttttctgccataaattaagggttaatgatagcatttattgcattgagctgctgagaggaccaaatgagataatgcattcagaaatgttgagtgttatttggtttggaaattgataaaaagggcaggtcttacatcgagtgcagctttacaacatattatccatgcatgattacatataaacaaaaatgtttagtttagaaagggaaaaatagtgggtac

SEQ ID NO: 3097 - DNA, 650 bp, Homo sapiens
ctcagaatgtgaccctatttgggaatgagtttgttgcagacataattagttaagatgaggtcatagtggaatagggtgtgtcctacttcggtatgactggtgttcttataaaaaggggaagtttggacatagagacacaaatacacaaggaaagctccatggaagataaaggcagagatttacaagccaaggaatgtcaaagacggccagcacaccaccagaagctagcagagagaagtccctggagagaggacgtgatgtctgaagctatggcagccatcttgtaactatgaggccacaaacaagaaaagcaaaaaccagagtgaagcatggcagagcagaaagatggaaagaacctggatacataagagtgtcactgtgcagctgtacccaccctagactgcatatacctggactttaagtaaatgacaaaatgagcaatatgatcagggatgtgcagttttcaccctgtagcactcttcctttactgcaggcatcatacacagctccaggcaagtcatttttcctaactctgtctgcctaactcactttgtgtagatttttcattgaataccatttgctttctattgtgactatttatacaaatattatagtctctcaagggcaatgattttccatcttttccatcc

SEQ ID NO: 3098 - DNA, 2313 bp, Homo sapiens
acaaggcctgcctggcacggctgccctccttagtgctccactaatgcccggaggacccagacagcgtgccccccatcgatgtcctctggatcaaaggggcccagggaggtgactacttctactcctttgggggctgccaccgctacgcggcctaccagcaactgcagcgagagaccatccccgccaagcttgtccagtccactctctcagacctaagggtgtacctgggagcatccacaccagacttgcagtagcagcctccttggcacctgctgccaccttcaagagcccagaagacacacctggcctccagcaggctgggccatgcagaagggatagcaggggtgcattctctttgcacctggcgagagggtctgactctgggcacccctctcaccagctacaaggccttggactcactgtacagtgtgggagccccagttcccacctctgtgacaataggatcatggccttacccttgaagcattaccgagaaggagaacagagatgggcttgaagagccacgtgctgccggctccaaattcccaaggacaaggatccctctgcatttttgtctatgtaacctcttatatggactacattcagctgcaaggaaaggaaaaccttgattgcagtggtttaaacaaacagaagattgtttttccacatagcatggattctggagatgggtggctaatggtattggttcaacaactccacgaaggtaggggtcacgtcttggatccttttgccttaatctcagtgctcgttacttcatggtcccaagatggctgctgtatccccaagaatcatgtctgcgttcaaggaaggaggggtggaggaagaggaagggccaaactagctggacccgtcaccttctatcagaaagtaaaacctcgtcagaagtctgtttcctgctctctccctctgcatatcttcacttagatgcccttggcccgagccagctaccattgcacctctagctgcaaacaaagctaagacagcagggaacagaattgtcatggctgaatagaccaatcgtgttccatctactgagactggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattgggtcttggaacaaaaacaggacattagtgggaaaattggaaatctgaaaaaagtctgaattttagttaatataccaatttcagtctcttggttttgacagatgtaccatggtgatgtaagatgttgaccttggggtaggctgggtgaagggtatacaggaactctttgtactatctctgcaacttctctgtaaatctagta

SEQ ID NO: 3099 - DNA, 1769 bp, Homo sapiens
cgggcagctggaagggcatcctgaaaagacgcctgcctgccgccgttctcctggcagcagggcgcgctgggaagcaccaggcaggaagtgaagaatttccggttgtcagcggagggatggggcgtcaccaagtctgtggcaagcacaccaagaaccagctaagtccaaggctcacctgcatggcaaatggtgaagagcccagctcccactgaaggcatatgacccagatcctgagaaccagatgcaccggcctgagctttcgtcagaagcaaggacacacagaacctttcttagaggcatcattagaggaccggacatggtggccagaggctgcagggacagaagtcccagggccatgtccaggaactgggctcaggggacctcctggtgccacctgcatatctgagcccatggagttcctctggtctattcagttctctcattttaacttaattttgtttttgtaggctttcttaaaaaattgcccagttcatttacctgatcacgtttattgttcagagttgagtgtggttctctcgtaattatttagtctccactgggtctgtgattatatttcctttcttattgctaatgctgtttgtgtttgattttcttcttttttttcttggcctgacttaaagaggtttgtctgttttatctttattttaaaaataaccaactgtttatttttacttctccactgtgatttccccctttatttctttaatgtttgagtttatattttttcctatttattttggcttaaattttattatcattttgctatatccttgtgtcaagcgcttaattcaattattttgttattttgacttctaaaaaatcagttaattctataagttttcctctatgtactacattgagcaaactccacagatttctgtagggggcatactaattgtaattcaatttcgttttccatgtgtaggtccagatttatttgaatgtccaaatacttagaattgtaggctcttgttttgttattaaagtctggttttattacattgtgtttagagaaaataatatggaggattttaattttagataaagcattaatatcttttttatcctcaaacatgatcaatttttgacagtgttccaaaaatatactatgaaatatatattatctgttggaatagagtaatatatgtacacactctgccatgtgcatatgtttatatatcatatttagtcaatggtagttgtgttagccaagtcctggagtcatctcgattcaagtttgttgaggcagaattgtcaatttcgtcctcagctcagcttcaactacttaacagaacctgattcatataggaattaagtaaatgtttgttgaatgaaattcagtgtccccaacctttttggcaccagggactggttttgttgaagacagtttttccatggatgatggtaggggatggtttcaggatgattcaagtgcattacctttattgtgcactctatttctattattattacactgtaattaatgaaatgatggtaaaactcacaataatgtagaaatcagtgggagctctgagcttgttttcctacaactagatggtcctctctgggggtgatgggagacagtgacagatcaccaggcattacattctcataaggagtgtgcaacctaatatagattcctcgcatgcacagaccacaatagggttcgtgcttctaggagactctaatgccaccactgatctgacagggggtggagctcaggtggtaatgtgagccaggaggagtgg

SEQ ID NO: 3100 - DNA, 6874 bp, Homo sapiens
aaatgaggacactgaggctcagggagctgggtgatgtgtcaaaagttgcccagctgcagagtggcaatgctggaatttgaagccaggcttttctgattctgaattccatgttttcttacttgcctttttcttctgctccagcttgcagtgcctcggagaggtggcgctggctagcctgggacttccaacatacagcctacattgatggcctgagacttgtggcaaaaaagactttcaaaatctaatttgctcacatacatgaacacctgccaggaaggaatttgaggcctttgttctaaacatggaaaagctgagttcatttgccccagagggggcacctgcagggaaaaggaaaaatggttttaaccctttccttgagtcagaaaatgaggccaccagattctcctttcatccttcaagtatcagaaaggtctgtgctgtgaattccacagatgagattcattgcaagatgtgagggcagaggaaatccatggaaatgatttgctcctccactggctcttcttgtagacacacgactgctacagtatcaagggtctgatgcagacatgacaatgtcaagaggaagaggagagcctcgctcttcccaggcttttgcttttaagagcagaaaaactttccccagagttccaccagctcacttctcatcttacttctttggccagaactggcccttgtgcccatattgtcagtcaaatgccgacaaaggaaaggggccactatgagtggtttagacttggattggatttgtccttattggattgtccttaagtcctttgaaaaagaagtatacaacagaatgaaatcttgactcagctttcaagaataaagagggtgagatgactgatggatggctagcaaaatcagatgtgggctctgtcctcatggagcatacagtcagaaggggaagatttacctaattacactaacaaacttataactgtggtcagtgttctgaaggaaaggaaatccagttgtatggtaacgtataacaaagaaactgaactaggatggagatgggggtggtaagtgtagttggggaagccagggacatgatctgtaagatggctggcctggattcaaattccactccacttacttgctgtgtgattttagattagtcgcttctcctctctgagctcaacttcatctataacaatctttcctagggttgttaaaggattgaatgagccactctatgtaaccacttgacacatattaggcacttcagtggctccttttccagattaaagaaggagaaaacgtgtatgtttggagttagcacaagacaggatgattcctcatgtttgttttggaaaacaagtcttaaactcacagccatgacagagtctgacatcatcagacatcaggcgtgttaagaattgcactcttaattgaaaatgtccagagtttgtgattaattgcaatccttttcagatcctttccctaagaatttaatttttctccccacccacccggaggtcaggcttttaatgtaacaagtacaatcaatcttccactgaagatggcctctctctagtgcaagctggagcaggactcatctggattagaagcctagacggtttggagtcacctggtgaggtttacgtgcacagctggggcccagcctacctaattaggaccagagagtggttgagaaggggaccggcgcgtattctaggcgccctcctccagtgtctgtttctaataatggcagaaagtagcagaggcggcggggtgagcttggagcgtggtgacatcatccctccagctgttttacacatctgtgacatggctcattaggactctcttaacacctcatccttccctgctccacacagctccagttgcatgagaaaaggtgctcttgcatgtgaggggccccaagactggggctgacttcagggtcaaagattcgcttgggcactctaccagtcatcagaattttcacagagacacccccccaacacacacacccgcagcatgcgctccttgaaagtgctaatagcttcaatatgaggctggcacttctgcatgactgttggtgttcagggccagcctagtcttggggagtaggccatctgtagcagctgcagaaatgtttttgcttattttgagcattctaagtttttcctagccatgaataacaacaatcgaataaatcatcccacagtgtgtaggatggtcgtttttttgtttttttttttcagcaagaacaacaaaaaatgacatatcatgtactatggataatacacataaaaaattccgccatatttataggcagcagttaactaactatatttagatatttgaaactgtcttaaatcagatgaatgataaaagcttcctggatttcagtggaaagcctaaatgactaaaccaaaaaaaaaaaaaaaagttttattactatgaagtatagtgcatattctgaaataaaagatatgtgatatttataaaataaaaagagaaactttgtcaatagacagcatcatttaataaagcagggtcccagatttacagacctttgtttgagttctaaaatttactaggaaggagggtgcaggggtggaagccgttcattgtagctctttaaatttcctcacttttgaatggagatgataaaatgcccctcacagggtttttgagaggactaaaaatataaggtatggaaagtgtttagcattgtgcctatcacaaagttagtgcttgaatatattagctattgtcattaatactattgctattcttatttcttctacaactgttattgttgaaatgcgaagtcaaaatggtacatttttatcaactattaagtgctatcatgtttcaattaatacataatgttattgattagaagatgattatagtattgtctctaaggaagaaaaaaggctgcctgttaaaccatggtttaacaaattctggagtacgggcgcagtggctcatgcctgtaagcccagaactttgggaggccgaggctcacgaggtcaggagttggagaccagcctgaccaacgtggtgaaaccccatctctactaaaaatgcaaaaattagcctggcgtggtggcgcacgcctgtaatcccaggtactcaggaggctgaggcaggagaattgcttaaacccagtaggcggaggttgcagtgagccgagattgtgccactgcactccagcctgggcgacagcgacagagcaagactccgtccgccccccctcccgcccccaccctaaaaaaagaatcaaattctggaaagcatcaatcatctctcaggcctttgaaaatgatctaattttgtagatcaaaccctctgtgcttgcaggtaggctcacgaatgcagaaagtgcatgctgtgagccatgctgtacacctcctcattgtccatttctcttctggtatctctcaaggtgtgtggtcaggttaagagattgagacttaagccaggcaggtgttacttcctctcaccatgacaaaacctgggacaatgagaagaggatagattctttcctcccgagggtgctgaggcaggatcagaatctctccctcgggtctgaaacagatcatatagaaggttcaaagctgcaagaaccattctgaaaccataagaatcctgagaacgaagcccacctcatgctaattgtggagaccaagcttatttgagtttacttgagcccttggatccagccgtgcctgaagactttttaataacaggaataaaaaattctattttggataaagcactttgagttggattttctattacttgcagcttaaaagctgaaatggtcctatgtgataagggaatgagacgatgattttgagcatttaatctaacaagaacaacaatactgtgcctgaataccacaacagggaattaggtgttgccttctgacagtatataaaagaactcatttctatcagtttcctgtaatacccatcagaatttctgtctcagaatttaattttctgagttgagctttaatgccatacatggacagtcatatggaattccagaatgtatttattataaaaatatcactgaagatattgttacatgtatcactcagtggtgctttcataagtaaacttctttcagaattcagtattaggagaaacctgagagaaggatatactcttctcctcttctgaaaatatgtgaataactaatcttacattcctgaggctgggtgtggtggcttatgcctgtaatcccagcactttgggaggccgaggcaggtggatggcttgagctcaggagttcaagaccagcctagggaacatggagaaaccctgtctctaccaaaaaaaaaaaaaaaaaaaaaacaacaccaaaattagccagacataatggtgcacacctgtagtcccagctacttggggggctgaggtgggagaatggcttgaatccaggaggtagaggttgcagtgggatgagatgatgccactgcactccagcctgcagaacagagagagtctctgtctcaaaacaccgaacaaaacaaaaaacaaataaacacaaagaactaatcttgtattcctttttgctctggctggctggaagctcagaaccagattaaaaggtcaatttcaagttattcacactaccttgtgattggttcatcttccttttctttggttcttctgtgtatcacacacatcacatgtttttgttttataccaccccaaattcttaatggaagaagcatgttataaacaaacaaataaaatgtgtccataattattaccattgtaaaagtgattatagaagagaaagagctggtaactacgttaacattttctctaagttgaaactgaaaaagtaggcagaggctctcaaatccaggtattgctatgaattataggagctttgcattttcattcttctgatccacacagctctctgtttaatctaacagctggggtccctgaggagatgaatgctttgctccgtggcccaggggtaaaaaagtgatatgaatctgacgggctttggctgcttacttgctatcatgggaccttggacaagtcactcagcttctcttggtctgttttctttggtgtaaaagaggaaatgcttgctacaggaagctgtcgtggagagtgaaggagattccggatgcatggtatctagcacagtgtctggcagattgagcctccaaaggccaggctttgtcttccttatgcagagtgccacctgcttttctgtaccaggggcttctgtctctttacagagccacacagagtcggatgtgactgctgcatcatattggattgcactctggccttgtgttggtcgatctttaccccttagccttcatccagaggcagcccaagaaatagctccgcatatcctgcattccgttcttgtagggctattgtggagacttggtcctctatgtgatttagggtacccagatgaagctctgcatgaatttttatttcagaaataagtgttaaagagaagctttgctgggagttattttctctttacaataaatattaggcaattgatgctcccccacccctacttcggctgctgggaaacccaaaagaaaaaaccttgaggagataaatgacttaaactgagcacccaatctctggaaccatcaagggacaagtaagcttcaccttctggcatggagacactcgcggctgtgggggaggtggagggccagcgaagggcggtgtcaggaggaagagcatgccgtgggagagcccagcagccctcaacattattttctcgaagccttgacatctccccggaatgtaggattttcctcctctagattttggtgattgcagaccatcctatagccaaccaacccccaagtgtgtgagccaccccagccaggatcagcagagccacctggatggcacacagctgactgcagaggcgtgaatgagccaagaccagcagaactcaagagtaataatatatacttattgttttaagccattgagtgtaaggatgatttgttgtaagaacaatagctgatatactctcccagtgtctgtagttatggggtatgcagtaagtgctaaataaatgcctgtttggtggaatgagatagtctcgttaagaacaatagctgatacattctcccagtatataatgagtgctacataaatgcctgttttgtggaatgagatagcctcatggaatggaattgaggatctctattattatgtggctttagggtatttcctagctgacttcaaagtttaaggagggaattagagaagagtgtattcatttgactgtgactcaggagacgtggatgatagtcctaaactgctgcctgtctgtggtatgtgggtcacttctattgtaggcacctcagttacctgacctacaaaatgaaggagagagccaggctggcatgaaagtctcccagaaccttggccaccatcaagcacggaacctgccctgcaaggatgcggctaccgccagagccacccctctatagatgtcacagtaccttcctactgtcccacactgtgctggttgctcctaccaaggcagtctctccattgtccctcttcttggtgtcaccagttccccgctgataatatggagagatggctggtggtgcgctggctatgtaccctgtgagggaggtggagaaagtgagagtctggcctttctagcttcagtagagggaggtggacccccctgtctttcactaagaatcatgaaatcggagtgccccaaacacaggaaggaggctcagatgctgggcagctaaacataggaagaaaaatatccactacgcaaaatccttcataacatcttgagagtccgagaagatgctctcaacgggagtctgtgagccttgacgtgggctcagccaaccaggagc

SEQ ID NO: 3101 - DNA, 1065 bp, Homo sapiens
gcctcctgtgccggcagccaacacagcactggcaaatcagggagctgtcagaaacagctgtccattaacggagtttgtggaaacaaccaggagctgtttgaaaatgctaggtggtagaatttaattggagtagcaactgttcaaaattaagattaaaaggaccagtcagtcaacgtggatttcgtgacaccttaaaaataacgtttcaggtttgattaatgctgcaagaagtttgcacatttctctcctttgctgatagggcctgcgtgctgatagttgattcagtgaatatatgtagcagtgatagctcatgggctccagaggtcagatatcttattctctaggctgaaacccttgttgctttaaggaaacaggattttaataggaatcacatgcagattgactacagggagccaagcggtagtggaagaagcaaagttggcggttttggagacggacgtctatctatccacagtgggacaaaaatgaaggttattgaaaagaatcatgcttggtggaagaagtaattacatttttttttcaaatctcagaggaataatgcttttatatttcctgcgatgacccaatttgcactacgatatgctcccttaaatgtgatttaaacagaagagaggaccaccccgccaaccaaatgtccaggtcctattccatggaacctatgaacaggttgtcccacattgcaaaagggacttcacagatgtcggtaagttaaggccattgagacgaatgattctggattgtctgttgggcccaatgtgatcaaaagtttccctagaagagctagagaagatgcgataatggaagcggaatcaaagacagatttgaagatgctgctgtctttggagagaatggccaggaggcaaggaacacaagcagcccctagaagttggaaaaggtttcaaaaggactggttgaaaactaagatcttaaatcaattcatcgtgttgggaatggagcaggatagagatcgttcctgaaggtaaatataaatttgacattttcccaaaattttacataaacaaaataaagtgaaaaattctgagg

SEQ ID NO: 3102 - DNA, 3673 bp, Homo sapiens
ccgcccgcctcggcctcccaaagtgctgggattagaggcataagccaccacgcccagccaatcgctttttaattctgggatattttaacaaaaagctcagcaagactttttttttttcttaaggtggagtctcgcactgtcacctgggctggagtgcagtggcatgatctcggctcactacaacctttgcctcttgggttcaagtgagtctcctgtctcagcctcccaagtagctgggattacaagtgcccaccaccacgcccagctaattttttgtatttttagtagagacagggtttcaccatgttggccaggctggtctcaaactcctgaccttgtgatttgcctgacttggcctcccaaagtgctgggattacaggcttgagccaccatgcccggccaagactattttttagaaccataaccacaatacagttaccacacttttgaaagtcgatgggaattccttaatatttaaatttctcaataggctaatttttatttttagggatgggggcttgctgtattgacgagactggagtgcagtggctattcctgagtattgtcatagtgactacacctcaaacacctgggctcacatgatcctcctgcctcagtgtcccgagtagtagtgcagggactataggcacttaccgctgtgatctgcttagctcatacattttaaaaaaatagttggttcaaatcaggatccgaaaaagttacataaattgtgtttgattaatgcgtatcttgggtctcttttagatctagagtgtctctcatcttttttaagaaacattatttgttgaagaaaatgagtaattctgtataattccccacattctagactttactgattgtatccccatgatttctctgcctcttgtgtttcctgttaactatagtaactataagttaaatacggaagtttgtgattaaggtgtttttttatttttttttttatttttatttttttttgggagacaagatctttctctgttgcccagggtggagtgcagtggtgccatctcggctcattgaacctctgattgctgggctcaagcaatcctcccacctcatcctcctgagtagctgggactacaggcgtgtaccaccaagcccagccaacatttatattttttgtagagatgggatctcaccatgttgcccatgcttgatttttaataagaatacttcattggtggtatttatagattttgatttatttccaaattgttctttcaaaagtttcattttatctagtcattttacaggacagcttttatcagttcctggtataaaatccttttagcctcagccttataatatgaatatctatacatacataatacttcatacacacacgatatacatatattcccatgtatatatatgtgtgtgtgtcagccacttacatgtcctgttactcttctatgaatcttaaatttgatattgctgttttgaatctacttcatcccctatgccttctatattctctctgcttgaaatctaccctcactatcttgaatgatgaagcctggtgacaactttttagataattttatgtaagataattatttgctaagtcatccagtgacatactcgggtattgtttgtctccctaccagcagcatctagtaggtacttcaaaatcagagcactttattctgtatttttaattttttctgtctttgcctcttacccaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttagggtaatgaattggaatttttaatacaagatactggttttatttctatagtagcctaatgatttgaggtaccacaacttgagtcatttctatcatgtttcactattatacatttgtatgtggatacttgctttctgatttctttaccctgaatttttagaagtagaaattaccttgttaatggcttccagcacttttatggctttgataaaggactttccagtgttgttataatttatggtgtgaatatatcagctttaacataattctcatctttgggtgtgattttttaaagagaagaaataaaatattgtaatcctgtagttgtttatatccaagtttaaatacagtatctattattttgtccagatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaaggtgggtaagccagttatttaatgatttaacctcaaaaatctgtgctgttagttaaaattactttcttttcagtgactgaattaaaatgccaaatatttggcaagttctttgtggtgtatattgtatgttctactcctgccacaaattatgtgagagcagattaagaaaagattatttaaaacttacttgcattgattaaaggaaga

SEQ ID NO: 3103 - DNA, 19331 bp, Homo sapiens
gtattgcctgtttcaaatgtgacagtgtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatggtgagtgagcccacgagtcaaaatgtcttttaagccaaagaaaaagggagtggtttgaagtagagttaattagcaacacgtttaggatttattattgcatataaaccatgatccatttggagatctaaatagcatattcccacgccttctccagctactccctagggaaacagtaaagttaacaatttcatttattactcctcaggtacagcttacttactcagtacagaagtgctgaagcagttctataaacttccaataattaaatttgaagtttttttaatggtcttttgaatacattagtaggttttgagtttgttctttttcttcatagtgattctacctttagatacttcctgttacaatttcagtcagcttttttccattggtttaagatgaatttttaagcactattattaaaatctggtaaatggttttgatgattcatttattttttgtagtattattctataagctttggaaaacacagatgaattcatatggctctattttaccctaacaaagatattagcaagtttttggtgacctttggcaggcagtggatgtaaatctattcattaagcgtgtgatttcattgaaatgatgagtctaattttcttttttgttgttaattttgaagttccgtacttctcacatgcatgttataagtcaacatgaagttatttcctgatagtggtatcaataagttagtaatttaatggagcactgaatgaaacttttacaacatgatctgctcatcatacattcaagaaaaaaaatcaaacaagaagctgagtttacagcagctcctgccacaaacagacttttgtttggaatcactattttttatattattactcaattgctattatgtctgctccaggcatagactattcaggaaatcatggaattctcaaaaagcttttagctctctttcagtagtagaaccggcttatatgttaaatactatacatatttagaaaaaggacttcaaactggagttataggagcttacaaatgcctgtaatggagtgcttgcaatggtattctgttcaaattatctgaagagctgtgggtaaggtggacattcaggcaagatggttagtctttacgcaaagtaataactgggttttaataattgagtctcttattgttaaaatgtaatgttttagtaacaatattactacatttggaaaatacttatttaaacagtcttcattcatagttcatatttttaccatatagtagcagcaaatatccatgaagttatgggagactcccgatgtgcacctttttcaactaaggtcgataaaagaaactctaactgcatacctcatatttagattctagtaacttgagggagatagagataaagatgttctgctagagatgagagcattattaaagagatggaagcatcagggaacagccacccccaaatgtcttagttaacatttttgaagtgtgcgattcactaatatttcctcagtaatcctcatgcaaacctatgatgcatgtactattactatttccatttaattgttgcagaagttgcctcttgtagctttcctcccatgtgaacagttattctgtacttgatgatcctggaagatgagcctgaacacatttctcctttcttgcctgagtatctgggaataggtagctactgcaacactgctttaatgcttttgttggtcacacaataaaggctagaacttatatctaagcatcattctgtatccctgtataaaagtagaaaatcagtgatgttcaaaggacaattagaatctttctttatcctcaaggaaatctataaagatggataaatattgctgccgcaaagacagataaatcttgttgggagctctagactactaaacaaaacaattggtttctactgctttctcattatagtttttctttaaacctttaactcacaggtgttcatacacttaacaaagaaaattattgactttaagaataaatccctagtaagattttatcaatgtgggacatttaaagttcatacgagagtccttaattggttccaaactcagctaattcttttggagtctttctaaatgcatgcatcaggaattctacatttaaattatttttctgcttaacatttttctgacatttgtagggaaaaatattatcttccgcttcattttctacttatcttagaaacctgtcacaacaatgccagcctgcagtttgctgtattttcagagggtcctattacaaaattggagcattctagctataaaaacttaaaactgttccttaaagtagctatgttaccctagatccaattctttcagaaaaaaaagcttatcgcaggattttcaattacattagaattttcactaggaaaatgatttagctttaataacattttaagaaagcctgctttatgatatacatcacaaaattatatatacttattttatttaagcagatgtccttagtaacagatataattatttacaattaaaattacattagaaattgacagtatgtagcagtagaaaaaactcatcctaaatttcaatgtatttgagaacaattgcacatttccgtattcctctttttttgtatttctcttttatgtaaatcaatgtcttgttaaactcagattcaaaaatatttctttcaagtcccactacaaaattctttttagaatgagaccagatacaaatgacaaaaaagaatgagagaaaatattctttcaaataaaatgacctgtctgtcagcatcccctcaaagcgcaaacattagattagttctactgcctgaagtttttacaatgtctcctgttttaatgtcacatgaacttcctctgaaataagcagtgggggttgcagagccagggagctagacattgggacagtggcccatgtgaggagcccaggcttccagtcttttcaaggaccagttggaaatcaagtaggggagggaggaacagtccatgctcacagcaccaattcaggccccatctacacgatcagagcaatgaaaacttagagccagccccactagatcattcttgttctagcagagaaagtggctgtatcctcttgtgtgttcataatatttttcacagagtttaattaggctatagttaaaacaagaacagataaatctgagatgtgaatggtagtgtagactaaacagtaacattttggagccagaaaagctgtgacctcaggcaaatcccttaaagtctgtaatcatcaatttttctgtctacacaagatatgcatcgtaacaacttttcattagggtgggcataattagagacaaggtgttcagggcaccttcacatggagcctgtccatgaccgggtattaatgagagagccattatgattacacaacattatatacatatccaatattatatacatacaatagtatatattatagaagaatatcatgctctatgaattattatgtaacaacacaaccaggcaactgaaagtgttgtgtgtgacccatagcgctctctcgttgggtgacctgtcgcttggccctctgtgagcctgtgagtggcatgtggcctcccggtctcaccagctgcatcagtgcctttgcttcaaatggttcattttggctctaattgccaaatgcagggcgagtggccaaataagtgaaagactcagattcattcactggtaacaggttttcaaatccatcctttcctggcataatctctcagcttgaatatgtgactggagtttagggagcatcgtatttacaaaggagaaacctctttccagcacagacaaggaaagcctgggccacggtcctctttgaaaaaaccaaactgctgtctaagcttttgagcttatttgcctgcattctaaacagtgaattttggacgtaaaacatgctgtctttccagtgactgctttgaggggaaagaaaggggagttcctacaaaatattccttggatgcatttgtcatacagccaatagcaatttattctttcctatgttctttcacaaatgttattaaaggttacagaaaattaaaacaataggaatcttcaatttatagctttcagagatgaaactaccaaattaatgatgcagagtattacatttgaggagcatgagccaataaatggcattaaagcttttacagctggaatatgggctccgccagcagattagggctctccgacaggcctgtttaccatattttggttcatttctaacagtaccaatagttctgaaacaatccctacctaaaagatttcagactccagatatcagagactctgataatgttgtaaatttatgtcatgaaatatgcaaaagtaaacataataatgaaatatcctgtccccacgtttgtaggaatcaaattgcttggctttatctaagatgtttaccattatagactaataaaaagttcattaaagagacttaaaattttaattcagatgcaggcacattaaaacatatggggaatgaggatgcctgaagtttgcaaaattttaggatgtttgtaccaggtctttgacctgtaatttaaacggcttctaagaaatagaagtaattattttatgttgatcatcttttaaaacaacttctaaggagaacctaggccttgtaagtcaacctgattcaaaccctccttgataaccctccttgatattcgtgtgaattctctgggaccaattctcatgctcttttcaaacgttgatgaacttctgggaatggattaccaaacaacaacagcagcaacaaaaccttcagtttttctgtcccaaagttgatgtatgtaaatgttatttctcctcacagagatttacatttaattttggaattcaggttcatcccccatggaattctgaacaattctgcgttcatgatttacattttagaaatttacttcgaagtccctttgaaatggttaaatgtgttaaatttgaaccatgagattatcctaaattccttgaggaaattattagaactactgccccccacatttctgaaagttagatttggaattgtcatgcatatatctagtctctctgagcacttcctccatgcacacttaactcatttgtctgcagagaatcctgggattataaagttggaagatccgtgtaggggtcctttggtctaagagtatctccaatttaccaaactaatcaaccattacttccacgaaggcaaaatgtttgtgttggtctttccttttcttatatagagcttggcacacctagtagaatcaggtgcctaatatgtgcttgtgtgaaattagttcactaactcagcctacgcaaccagtacttatttattccgtcttgtccaagcagcctcactacttcatggggtagctgttctacttccaaagagaaaggcagctcctgttttgaaaggaaatttacacctaacatttccatctggttcacctctctcatctaaactacacagcacaatggttaatccttttccacatatagcaagccctcgggaaattatagaaaactttccttccccctcggtattcacttctccaagtgcaatatccctacttcttccaagcattctctataagcagagctcccaaagcctggaaaatctttgaggatggggagggaggactcatttctacagaaacagatggttgtgcagcgatctaagtgagagggcagcccaggacagcagatggtcctgggaagggctcaggcctccctccctcacctgatgcccccacgcgtggtcagcccataaagacctctttaccatggtgaaacctacacatgcttatgaggttaaatgcctttcctcttcactgagactgctacatttgagtctattttcaacccaaatccacttataaaaagcatcaggggagtggggtcagtcacaaactgtaaattacgtctctatgtgctcttctctgtagacctccctggttgcgcctgcccggagggaaggattattctgagttgtctgtaacctggtagggcgatgtctaaagaaatcagaatccagctctgaaggctgtgtcttagcttcctggagccacgtaacaaattaccatacacagaatggcttaaacaacagaaatgtatcgtctcccagttctggaggctacgagttaaagatcaaggtgtggacagggccagctctcactgcaggctccggggaagcctccttcctgctgcttctagcttccggaggtgccagccgtccttgagctccttggcttgtggatgacgcatcactccagtcccgccccatcttcatgtggccttttttcctgtgcgtctgtctgtgtctcttctcttcctatgagaataccagccctcataaggattggattaagggcccaccctactccaatactccaatattactttatcttaactactttcattggcaatgaccctatttccaagtaaggccacatcctaaagttctggaaaagacaggaatttgggggagacactattcaatccagtccagatgatatacctctttcctacagcctgtggggagaaaatctcatctttgataaataaaggtagaggttttgtgttcgtttcactccttcacattgctgtaactagtgttactgagcctgctctgcacggactaatgaaaactccctctttcaacaacaaaaatgtcatgccttttcctttcagcaggaagggtttgtttagttaagaaagaaactgggcctggataagttttgagtaggggagatgcagggaattgatgtttctcttcttcttcggtaatgctgcaaactaaccagagatggaagctcacacttccaacagctctggatgctgccctggggatcccatagcagcaccccagggtgctgccgcaccagcccagtctcgagggacctggccacggtgaggctggttcacctgggcctgtcccggcccaaaccagctgggcaggaggctcaggccactctgcctaaaggggtttgtaccaataaatgtgggtcacctggtggacaagcaggggaagatgcttgggcagatgggataatttgtggagaaacaagaaatgggacaaagcatgcagctgccgagcacagcactgaggcgcaaaggctccggctgcagttcttctgggttcaaactgtttgccggctgtggcttttgacgggtcatgtaacaactccgtgccttagtctccataatttaaaaaccaagttactgggaggattaaagcagctcattgacttgcagagaactataagaaggtcatttttcaggagttctacttggagagaaggaggggaatgaattgtggaatcgagggtaagtgctttgaaactagcgtgttaggtaaatgtctcctacctgcagcacagggtttatggagagaaccaaatacatgtggctttatatggtccttccaagaaaattaagtgaaatctttttaagttaatatcataattaacatctaagatgattacatatgaaataaatattcaagaatcaatacctttcccatatgtcagcagtcagaaatgcaatgcaaagttcattttctagatgctactaattcctaattgcaaatattccaacccagacaaactttcactgctcagctctcccttcccccgaagacagtttagttccttccttggccctctcacatcattgcaaagaagggctgagtagtgacctacgcatagggctgcatcagcaggttcactggcctgccccagtgaactagtgaaatcccaacctctttccactgtgttctgttttcgattggcccttatatttgtggtttctctgtataaatctttccaagttgttgtggccaagtttcctctggacatccccatttcaccagcatctggctttaccactgtccccacttatccaactttacctgaagggatcagactgccaggaggatacagagttgcagataggttcatgacccaggcacatccccattgtttctggaccagtggcaaatgtggtatatcaagaatggcttgtgtaagagaatcccattcattgcttctgaaacggtgatgaaaggtgtcgacaaaaagagtcacactctgtaaaatatttaaagaggcttattctgagccaaatatgggtgaccatgacccagggcacagtctcaggaggtcctgagaacatgtgcctaaggtggttgagttacagcttggtttttatatcttttagggagacataagacatcaatcgatatgtgtggggtatacattggtttggttcagaagggcggtggtttacaggtcatagtgggttcaaagagttcctgattggcaattggttgaaagagttaagttattgtctaaacacctggaatcaacagaaaagagtgtcagggtcaagataaggggctgtggaaaccaggtttcttattatgtagatgaagtctcataggtggtacccttagagaaaataagttggcagatgtagactctccgtaaatctcttcaggactgggagggtatggaatggggaaagatctattatgttaatagagattctttatagacacaactttctccccactaaaatgacttttcagtccatttcaaaatatggcaaagaaagatatttggggtgaaatattttgattttctactttgtctgtcatgtgaggttatgctagagtcaggctggaaagtaagccacgttatatagggttaaatgaaacctctctgatgagattttatggtttgtggggtgtgactccccaggtcccttagataggaatttgggcaagagaagtaaaaggtcagagttcagtcctcaaaaggaactgcagtatggaaacagcagctcaggatggagctggaactggcactcatgccccctgcctgtgtgtggaacaggccatgtgatctgaagcctgcttctcagcctacgagacaccctactgccattccagggactctgggagttatctctgctcttccctccatatccacactcagacatcccatcctttcagtaacctcccctgactccgcccccactagcagaacagagggctcgtccctccgattattcccaatctgccttgctgggtagaggtcctatttcttgtgtccctcctcaccaggcgggagagcccagatgccgggtgacagttgggacaactggcttttggctggacctgttttcaaagccatgtttggaatgtgtgcttttgttacaggaaaggggtcctgatccagatccaaagagagcattcttggatctcacgcaagacagaattcagggcaagtccataaagtaaagtgaaagcaagtttattaagaaagtaaaggaataaaagaatggctactccatagacagagcagccccaagggctgctggttgcccatttttatggttatttcttgaagatatgctaaacaacgggcggattattcatatctcccctttttagaccatatagggtaacttcctgatgttgctgtggcatctgtaaactgtcatggccctggtgggagtgtagcagtgaggacaaccagaggtcactctcatcgccatcttggttttgatgggtttgggccggcttctttactgcgacctatttcatcagcaaggtctttctgacctgtgtcttgtgccaacctcctatttcatcctgtgactcagaatcccttcactgtctggggatgcagcccagtgggtcccagcttcattttacccagcttctatttaagatggatttgctctggtttaaacgcctctgataccttgtcacccctccacccctctgaggtaccccaacagggatccacagacaaaatgactgggttgtggctggtttccagtgcttggccagtgacatccctcctgctagctgggaactggcacatttcccaatcagagattgcgaccaattcagctaaggccttacagatctgcctagagaaatctgtataatatgctttaatgtatttaaacgctcaaaatgggccccaagtgagcaggcatgcacatattcgcccaagagaaaatagcgttcttttctatttatgcaacagaaagttttacttaatctgagcaagaaagcaaatagcaatttctaaagctttaatttaaggaggcttctctattcagtcagctcataatttgtagtttttaagtcccctaaaatatcacctattctggatttgctgataattgagagttcattctgattttcctttatatgcaaatcttccatgagcaccaactaatgactttttaaaggtctctttgtggacattgcagagaaagtaagaatgtcaccaagtgtaattgttatgctgaataccactattcatgccatcgttaaaaggtccgtttaaagggggtgagagacaaaagctaagcttgactggatggaggagcctttccgtgccactgcggaacccctcgcaggggtgggtagtgagggtgagtaaattgttctgccctcccctgagttcccaggctccttgagtcgcacgtgctcttctagagactgatgggaacgctcagcttgcttcactctcagaccttctctccccgcccagcgcggacgggctccgggctaggagctcgcagagggacgggctgtgtcgcctcgcctctccctgcctctgtgtaggaattccccgccgctgaggtcaggagggcgggagtgacacaggagccgtggctgcctggactcctgggctgccccaggagccgaggacagccaggtggaggcggctacggctcggcccgaacccaccacggcctcccctgcagggacctgtgtccagcctccacggccctgcagctgcattcgcctcagcctctcgtgctgggatccctgggcccttctagattcccatcacgcagggtcaaaaatgcccccacccgtgcacgctcaccgtgagaaacccactcccatgccgtgcactgatcgcccggcgtgctgcccggactccagccctgctgcctcggcctttccattctgcaccgcagggaaggcccaggcgtcgcgcggccagcccctggggacaccttcaggctgctcgagagggttccagctgccaggtcaggagcagagcacagccaccgcgccctccaaggacaccaaggcacgtcccgctgtccccccagcgcgtggccagttccccgcgactctttaagcagttctgctggcggtggcccccacacctgcctgggcccacagctcacccaggtcgagggaccctcgtgtcagctccctgccacacctgtggtttgctttctccaaataggaaactgttggagaaatgttcctcttagtatgaaatcagctttccattttattgcctttcttaaaaatctgtaatttttactttgacagaatggaatataaatggctcagaagaagcttaaccatcaataaatgtggagttgaaaaatgcaatggacatattctctagaaaaactgcaaatattattgatattttcttgcttgcctgctttctgtattatattctcatgtacatcttgaattaatgttccaagtaataaagaagaaaggtaaagatggcaacgtaattatgaccaagttctgttcagagccctcgaagatcaatttactttttttgctcttaagtacagtactttaatatgagctttagtgagcatatttatattcattttgaggcggtcatacaatgaaattaaaaatcattctccattcagtgacttttaatttagattttgcataccaattacaactctgcctctgcccccgccccccaaaaaaccctacatttcatcttaagttcatttcttgaaagtatctttgtcacaaactaaaaaactaatgatacaatactggaatttaaaaaacaagatgtaattgggccataatgacaggattattgcctggtaattttcccactattttaagctttgtgtttgacctgcatgctagttggatatttatttgtgtacatcgggttttgaggagttcatagtttttctaacagaaatcactgaatgttacatatgtttgtatgagtctttatttattataaatatgataaacaatcacctaaccaaatgtcttagatgttgttctttctggaagcatattttgtccttccaaagtttcttacaagctgtgagtgtaggataatgatattcaaagagaatcagtaccttttctatttttttgatgaccaactaaaatttctagaagaatttctgttaggaccatagacaaccatggagtgaggagaaggagtgtgatgtcgggcctgtaaaaacctgcttaaaaaacaacccacacattcacctttcttcgtgtacctgctgagctagccactggcggtgtggaacatgaggccttcctgctctcaccgtaagcctggttgcgctgcctacacaaagactaatgcaccaggctacctccaaaagcattagagagcaatgtggtttttatgaaagtcttttttcggggggaatgccaaagagagaaccacataatacatccttcactgattcatttaaacaaaacaaaacaaaaaaagttgagtgcttactatgtgccagcgcagcaaagcttcctaaaaaatcctttaaaaacagacactatgcggccacacagtcattttcaatttaccaaatccctcaaagacttccccagagcctcgcccggtgaacctgaatcaatgtgtacagccacggaaggcctgaggggtgaaggaggttttcactaccgtcgggaaacaagcaggtctagaaaaggatgggaaccttgccacacatggacaccatcctgcaaactttatgttccttctaaccatatatccttaccttctactcctctctttaataacctgactctgaggtcagggtacagtttggaacagtaaaatccagcactgatggcagacttattgaggttgctaaatggcaaaaagagtgctgtttaggcttaatgctctctcttagctaatgaaacagtgaagaactgcaatccaatctcagattttccaccatcaacataaccctcctgcagaagagtaggaatgtcagcttcatcagtgctactaacatgctttgcatcctgggaagatcccaaggagagtctccctctctgggctacctccaaatactgtccatcaggtctctcctgaaatttctaagagtattttttttccaaatctttgctaggagctgcaatgtatatgatttttgctaaatctttgctaaggaccacgtgatgatatgtatatcttgcttataaacccaaccaaagcgcattagagaccatttgtcctgaagctacctaccaactagatttgcgagtccacccaaatgtgtatgacatatggtcagggaggatgatacatcacctgttgcatttcccatcatgaggactgcctaataggtctagtcttgttctaatcttaatagtcctgtgagatccaacagcaatgagctgaaagctagggtttgtttgtttgtttgttgtttgttttaatgtaggtattgttactaaatgtaaattccatgaaggcagggacttttgtcttttttttcactgctttatcaacagctcagcaattgttcttagcacttcctgagattaataaatatttgctgaatgggtggatggagggagagtgtattggttttctattgtcacaaatttagccgcttaggacaacacccacatattatctcacagttctgcagatcagaaatccagcagactcagctatgtaatatgattagaatctaataaggggatcaaagtgtcagttgccctgtgttccctgtagagcttctgaggaagaatccacttctaggctcatcccaggtgttgatagaaatcagttctaatggttgcaggactgaggtctccatttcctggctggttggcagcagtggggagctctcaactgctagaggcggcccacattccctggcccatgaccatctcatcttcaaagccagcaatggagggtttcctatcactcggcctccccttctgccgcatctcatctgccttccttttctgctttcaagggctcgtgtgattcccacccagataaagaagagtattgctcaagtagagtgttaactaatctaactttgttccactttttttttgttacaaggcatggaactatgtggaataatcccttgttttaaggtcagcagattagtaaccttaattctgtttgcaaagtcctttcacaacaataccttgattcatgtttgactgaataacaaggggacggaaatattggaggaacatctgtagaattgaggttttggaatgaagtcatcaaaaaattgatgcctggatgaccatgactgggagcttgaagtacatgttcaagaggatacaaaattaactgccaacatttagtgaaggtagcgcagctcgacactgtattatttttggaattgttattcttactttacagatgaaaaagctgagcattggatcaaatgacttgcccaaggtcacagggcaggaatgaaccaaagccagcacccaagaaataagcaggtcctccttccaaacctgagtggcaggtactctggaagtgtaaattggattgccagaaatagcatttctaaggtaattctgatcaaaagatttcttttatttaaggtactgaagtaaatggaagtttcattgatccgatttaacaactattatatgctggtagatcaaagtagctgttgctgatcttcacaaattcttatgcattatgaagcaaaaatgttttcatatcatcaatttctattgtggagtagtgttcaataatatcttgagaaaaactctaaacacagaaaactatcagcaagttcacctaattaaaaacatcaaacagaatcttctaactttgttccactttttgtgttagaaggcatgtaaccacatggtgtgcattcaatttttttttaatcccagccaaattccttctcagagttatggataaaatctgtgtatgtagctgtcttcgtccatttttgtgttgctataacagaatagctcagactgggtaatttatttttaaaaagaagtttatttggctcatgattctggaggcagggaagtccaagattgcacagaccatttgatgagggtcttgtgctgcttcaacttcaagttgaaaaggatgtaggcaggtgcaaagagaccagagtctctgtgggtctcatggggaaaaatagtaactcgcatgtgattcatttgtacaaattttagtaagatatagagcaagcttacaccttactcttttaggcaatttaatttacacaatgttttcatttctaaatgtaatcctttggtaaaagaccatttgttttaggtgcaattgttcacaatctcttttgctaacaaatcacatagttctcccaacaattctcccaaatataataggtaaacacattaaaaattgctcttgccatgtatacttcaattaccttgccaaattgatatttcaagttaaacacggttgtatattatacagagaagagtgttctcctagtcttaacaataactcattgaacaagtactcttatactatttatgaagtaattcaaaataaggcactaatctacatttactagtacattatggagaagtacttctatgaccctattcctgaaaatcagcctacattttcttagaaatttctacctacttttactagaaatttattgcactagtaagtttttcttgatttcccatattaaaaaaaaataattcattgcaaataaaacctttcctgagtaataatcacttggcatgtaaatgattttagtattaatataattctctctaaataaataacttccaggcccaatgcataatgtaccaagcacacctattaaaatgatagttttgtaatgtgagaatttccattataaaaacctgcgagacacaatctagcacatttaaagaatgatcacttttagattgtaactggaagataaattctaattactatttaatttcttggttgaacatctttggcatgtacaacataaaattgactctgaaattatgcagttaatattatcagcacttagctattccatttgaagctgcaaaggtttaatttgcttggctcaaagaaatattcaaccagaaaaaaaactgcttaaagtttgggaaatttaaaaagtggctatcgatatagttaactaatctataataagctatgttcagtgaaatggctcaacattgggtcattgaaaaaaatggtacattctttagaaagtatgctatttgaggtgttctagaccaggaagataaacatgtttttagaattctattatcaaagctatgggttaatatccaacattgtgacgtgatcctgtgactttagtcaaatcagtcatggaaagttagaaatctcctcccttaaacattgatgcattcttagaattgcttcttgcctaaactatgtttttcaaaaatgtaaatctcagagagttgttcttccagtcacattgctggagtagagatttataatttttaaaatttttaatgagattattgacttgttaatttgtagattattgacttattaatttgtttcaagttcttttgtgttaactgtcttaaaaatggctaacagttatttagtgctttttataggctagattctggattaagctgttttcatgaatcatctcatttaatcctcacaaacccaggaggaagaaagtatccttcctctaatttaacagatgagaaaatgaatgcagagagataaagtaattttcaaactgtcaatcagttagtaaaagggaacttataggattattcaaatggaaagagagataaaaagtgataacttgtacagttttctccatccataaatactgagtgcttcaactgcacctaatggggtatttaattacactgttatagacaaatcattcagctatattggtttaatcttccagtgtttaaactagcagtaataaactaataacattcctaaacttccagtttcttccaaagttatttttattcatgttactaaattaaaaaaagtagtgttcaatactaattatttactgtgatctgttttttaaaacatctgagtggcattattcttggatgaaaagtaaatccaaattcagcctttatgtaatagtatgacatttttacttttggagtttataacagagtttaataaatgtataacatgagcaataatcaagatttttattgcatatgtttattaaagctcacttatagctagttaatagagtatgcgtagattttgctgagttaataaatccaatgcaaagtaccacttgtacatgatgatgtagatagcttcactataggtatcctgaagcatggagttcttcatgcacaatagtttgtcctttgtgtgaaaagataatttgctgaccatttgtgcacggaagtcctcatcatcagcaggacttaacttgagatgattcaagccaattgcaagaaatgctctttagaaagaagaatttacaagacttgctcattaaactatgtaaattaattgtaacttgaaaagaggaaaaaaggctctagtttcacttttttaagtttggggaagatgagttgcaaataatgatcaagaagaaagtcattctgtctaaattagggcatggtggatcttcagcttgaatgtttatcttgagagaatgagaaagagaaacagagagagggagagaaatagataaaggaaaaagaaggtcagtgaatatgatgaaaagcacaagggcattttagtaggtagagagattaaaacctaaaaccatgagggttctttcatattttttaaaatctaatagaaatatgatgagaaagagaaagatgttgaagatatacagaaagaatatcaagtagagccattgatcttaactataaatataaggcagagatgcattgaaaataaaggccacaaactgcaaatgaatgaaaacacttagtatgtcacaaacatgacaaacaaaaagctcctggaatttttcagactgagatggccttatttcattggtggtggatcccagttgagtgtcaaccctcaacgagtgggcagagacccctgcctgaatctcctgagtcacacggcgcacactgcatcccattaggactgatactgttttgcaacagcttaactaatacaatttcaatatttaaccaaaatctgctttcctgtaacgttcccactgggggcttcatttggctgtctggaccgggcctctctgcttcatgagtttccatagatttcttggtgaatattcttctcgtgcatcctgttctttgatgtattgattttcaacaatacatcaaaatcaggtacaaggcagaccttttctttgttggattccaaatgtacaaggactcaatcttgattacatcctaatgctgacgtttctagacaatatttatttgctgttctttgtttccctttgtttctcttgctctataaatttctccaaaatcctaacatgttgtttgaaatttggttgtttcttcttatgcaagtttgcatttcaagttattttatagcctagatatataggaatcctgctttcctccgaatgtgtaaaaattaataactgttaatagtcctctgctatctaagttttaggtttgacataagggaggtggtttgaggctgaagccgtctgatgtggtttggctttgtgtccctacccaaatctcatgtcaaattgtaatcacccatgttggaggaggggccaggtgggaggtgattggatcactggggtagatttccttctttctgttctcatgatgatgagtgagctctcacgagttctggttgtttaaaaatctgtagaaccacccactttgctctcttcctcctgctccaaccgtgtagaaagtgtctgcttgcccttcgccttctaccattgtaagtttcctgaggcctccccagccatgcttcctgcacagcctgcagaaccgtgagccaattatacctcttctctttcc

SEQ ID NO: 3104 - DNA, 863 bp, Homo sapiens
tggaagacagccaccaggagagatgcctgactcacattggactatcatgtggacaagaaataaaatgttattgtgttgagacactgtgctttagagactgtttataagttagcattagtatatctttacaggggaaaaataacttgtttccactgttccaaatacccatttcccataccaaggtatataaaaaaccttgttgtcagaggcttgcttggtaagcatgaaatagaacaaagccctgagagttagtttatttaactgcaattcaacttaagcaagactttttgctttagcttagaatactggaaaaaagttgatattgcaagtaaggtgggaagggcatttaaatggtcatttttgaaacatagggtaccatctaactacctgttcatcttttgatttaggaggaaagaggagcatgagaactcagaagaaattgtacctactcagaagtgtggagtgaggatagacgttcccagattcaaaggcatcatgaagtgtcatgacaagatagaaaagactttgggctggccaagaaggaactggataaaattatgagtgaggtacagcaggtgggaacagtgtcactgaaccctatcaacagcagagcatgagaacgtgaattcctgctgctggggaggcaatgaaatgatatgggccttcagatgtctatgaatcctgacccaccgtgggtgccagttttcaagagggtaagctgtgctacgttttcaccctttgaaacctgcttgttctgcccttctcaagttcccagaagttattactgcctggctgagagattcctgttttacttattttcccataaagaaaccatctcttagcactcatgccctaaggaggac

SEQ ID NO: 3105 - DNA, 6496 bp, Homo sapiens
tctctctgtatttacttggaaatgattcttagaagtttttggcatgggacttttaagtttgttaagtgaagggactagcacttatctatatgcatattttgcaagtatttttaaaaatatggctcaattgttaaatcattttattcgtcccatgacttatataaaaatctgggggttttttggttgctcacttttagtttaggcttggttttatggtgatctgggctcagggaggtagacatgtcaatgtcattagcattgccaaggtataggcagtctgctgcatgctgtgtgaatattaatattctgaagagatatttgagtccacaagatttaaagatcttctgttcaccgctgtgcttgtagaattagggctaaattagtttagcctgggcctcctgggtcttggtcatttgaaaatagctcctcaagtaggctggctatgtgtcttagtatagcagaaacaattcattattcactccatgtgtcgtctattatactgtgaaattacagatgatagttttcttgctttctgtttttccaaacagtgccacctggacttgtgggtttggctcatatactgactgtttcttaatcaagatagctttaatagtcttcaccctacccccatcctccagctgccctttggatgttgctgtgtagaaaccaagagagttcatttttgttgggggctgggctaggttgctaataatctgaagcaccatgaaggattctgacctaatcaaggcataaggaaatgatgtgtgtgtgtgtgtagaaaatttggaactgtgccaggcacaaagtaaatgtcatataagcattagttatgaattgatgaggaggaaggtgtcagaagatgaatgctgtagagaaggctatggggcagtacatggagagagtggttatctgtagagatgtggttttgtcataggtgatgggaaaggtctcagtttgaaggtgatgggtaaggtcttcatttgaataaagatccacaagagagtatgggtagaggggcatagaggtgtccaggtagcagataaggaggtcagataggcaacctagggactcctggacagatgtagcaaattgaaggtttttagaaaacttaaacgggaattttttaatggaaaatttcaaacttaaacatagaatagtacaatgaacaaccttctcccttctcccagcttcggcagttatcaacatggccagttgtgcttcatccatgttgcccactggcattattttaaagcaaatttaagaaattctaccaattatttctatttatcgtccccactgacattctatcagttatttctaaatacttctgtatatatatttctaaaaaataggcacttaaaacataaccacaatacttaactttttttaccttgtttatcatctgtaaatcttggccttagagccttcttgcagcactggttgaaagataagcatggataggccaggcgcggtggctcatgcctgtaatcccagcactttgggaggctgaggcgggtggatcactaggtcaggagatcgagactagcctggccaacatagcgaaacccagtctctactaaaaatacaaaaaaaattagccgggcatggtggtgggcgcctgtaatcccagctacttgggaggttaaggcaaggagaatcgcctgaacctgggaggcagaggttgcagtgaactgagatcatgccactgcactccagcctcggtgacaagagcgaaactttgtctcaaaaaagaagataatcttggatgtctggattccttagggtagggtctgacagtaggtgctcaattgctagtggtcatctgttgtctttaccagcccttgatttttttttttcttttccttttctagatagttctatcatgacaatttcacttttacttcctctttcttctccttacctatttttgacacatttattcagtatttcccgtatctactctctacttctccttttaactttctcctatcctttcagtatttttgttcacagcctggtgtgtagcttgtgctcttttgatccctgtagcccatgaaatacagctccctttagttctagatctttttgaagggagatgagcatttcctattcttattttttaaaaaatactgttactgagattgagatagaatttacatgccaaatgcttcactgatttaaagtgtacaagtctagccaggcatggtggctcttgcctataatcccagcactttgggaggctgaactgggaggattgcttgaggccaggagtttgagaccaacctgagcaacatagtgaggtctttcctctacaaaaataaaaaattggccagatatggtggcacacctgtggtcctagctgctctaaaggctgagacaataggatcactagagcccgggaggtcaaggctgcagtgagccatgatcatgccactgcactctagcctgagcaacagaggccgaggcgggcagatcacctgaggtcaggagttcgagaccagcctgacaaacatggagaaaccctgtctctactaaaaatacaaaaattgccgggcgtggtggcgcatgcctgtaatcccagctactctggaggctgaggcagaagaatcacttgaacccaggaggcagaggttgcagtgagccgagatcgcaccattacgctccagcctgggcaacaagagcgaaactccgtctcgaaaaccgaaaaaagaaaaggaaaaaaagtgtacaagtcagtgattttcagtgtattcacaaatatatgccatcattaccacagttgattttataacattttcatcacctcaaaaagaaacctggtaccctttagctgttcccatcccaccaccctaagcaaccacgaatctcctttctatttcaatggatttgcctattctggacattttatatatatatatatatgaaatgtcttttgtttctggcttttttcacttagcatagtcatttcagtgctcatccatgtcagagcataaattagtacttcatttctaatgatggttgaataacatttcattgtacggatatagcacactttgttaattcatcaattgatggtcatttcatttgtttccactttttggctattatgaatagtgctgctagaaatattcgggcacaagtttttgtgtgaatgtgtgttctcatttctcttgggtatatatatccaggagtagaattattagattaaatggtaactgtatatttagtatttgaggaactgtcagaccatttttccaatatggctttccattttatttgcccaaacatggaaatctagccatttttcaagtgcagctgcctacctttactttgggtaaatttctgtattaatattttttcactgtcttagttatcaaattctgttgcatgtaaatctggttttttttaatatatgtaaagtttttaggtagaatgttaatttagtggtggtccccaaagtggagggcatttacctttaagtgtaagatgattcattggaaagaaagaacaaaattctatttttacatatgctgtatgtatcctaatgtattagcatagctgtacacatgtaaggtgtataaattaatattcttatattagatctgtgtggtgcaaagtttttttatacaagtatgaataataataaaattttgtgaacaattgtccagaggcatgaaatcaaatatacctatgtaggtcttaatcctatattttatgacatgtctgatgggaaagttcttaaaattactttgctaatgaaattgaaaatagcctgctaatttcagcccacacggaatgtgtgaaataccagtggaaacagctttggatcaggttcagacttttgtttttgtcctacttctgctaattactaatggcgagactttgggtaagtcccctaatggtctccatttcagttctcaacttggcataataacacctgaaattttgcaaattataactttgcagaatgagactgggaagggcgtcatatgcagcgaccagagggagttagtcatttgggtgttttgggcaaccctgcagttcttttaggtgaaatattcaattttccatgaactttgccttccccttcttacttacccatttctcttgattgctttctgtccttctgttgtgttcttctgacagcaaaccttcaaaattaatggtcattaccaaaggctaaatcagctggagtggagtcctttgtgataccacccagccagggaaacagtatagcactgtttcctttctgctgcttttattacaacatagtatagagtatatagatgaaataagaaaattgcagtttactgcaattcctggacactgttttggaagctgttgagttaaattattgggcatcttgatggtttctatttgatatgtgatagttttaggctctgttattctctttgggatgtgaatctttgcctaacgtcaaagcatgaagagaagtagatcctgagaaagaagggaagaagttctggggaactgtggtaaccaaacagctcacatgctacagttgaagatttattcatgctctactcagtatttgtttattactggctgtgcttagtaacgtaccataaaattgataaaaatgaattttacttttcactctagactcttatttatttgtgatttctattctctagtatcctttattctaaggaagtggttgatgaacatttaggtcatgatttctaatttcttctaaagggtgacatccattcttgacttcctttcttgggtgacaaggaaataaacaacataaccatatctaggtatcgtttgataatttgttcatgatttcattcataagtgcaaagaatatatttattgaacacctattattgccactggtctgggttctggggacaaagcagtgtccaaaatacgttattttaaaaagtgccctcggccgcctgcggtggctcatacctgtaatcccagcactttgggaggccgaggtgggtggatcacctgagatcaggagttcgagaccagcctggccaacatggtgaaaccctgtctctacagaatactaaaaattagccaggcatggtggcgggcacctgtaatcccagctacttgggagactgaggcaggagaattgcttgaacttgggaggcagaggtcacagtgagccgagattgtgcctgggcaacaagatggaaactctgtctcaaaaaaataaataaataaaaataaaagggccctcatagatttaacattctggggggtactagtcattgaggttagatacaatgagatttgtgctaaagagagaaatagagctaaagagagggataggaactgtttgggaggggcaattaccagtttttatagggtgaccaaggaagcattactgacaaggtaagatttaaggtgtgtctttactctgatgcccccagttgtgtattcaataggcagttagtattggggcatagaaaatcctaaaacctaaatctgatgtacttttgcctattcatgaaataacttgaagactgttatacatagtgggagctaaagctgctctgccctccaagtgctggctgcttatgatctgaaagacttctgtgaggtcaccgtaggcatcatggtggcactgaggcatctatccctcctgcagaagttgcatctttgctgttaatactgtgtctctggtggctctagtgatgcaatcattctcgatggggccactgactctgatgtcacaatgacttggctggaggtgtcctgaagtctcttgtttgtccagggcctttgctgcagcttatatgttcactagtaatctggcctgtgcctaccttttaatcccagctggaaaatctcagtaagaatgatgataaaataaaaaatggggatattgacctcctgtcactactgcatggactttgatggtttccaatcattactttctcctctgtgtcaatctgcctcttcgagaaattcatactcctggtgagtgtccgacctggccttttgtcttctctctgccactgcccagctgtgaccttagacatggttgtgaatctattatgggcctattctaactctcaatgctttgattttataacctggcaaagcagcacctgctggttatttttgtgaagcaacaacacttttctagaaggaagtgaagaaagcacctgcttttgacggttgttttttatgaggacgttggtttttgctcaattcacttaggtcagtccatgtatgggaagttccaaataaggtcattctctttgaactattaactataacttgtttataaaaaacactgggatcagccaggcacagtggcccacacctgcaatccagcgctttggaaggccgagttgggtggatcacttgatgtcaggagtttgagaccaacctggccaacatggtgaaaccccatctctactaaaaatacaaaaattaggcaggcgtggtggtgcccacctgtaatcccagctgctagggaggctgaggcatgagaattgcttgaatc

SEQ ID NO: 3106 - DNA, 3639 bp, Homo sapiens
atttcctgctcttgaatatctggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggtgagtatttggtggaggagattaacaacagacaatttagtaagcaattattatgtgccaggcactcttttaagggcttgacatgcataatctactttaatttgtatataatctggttttatctgtattgggttggtgctgttaatgcccatttcacttataaagggtgtgagagactgagaggttattttacctttccagggttataagctagttagtggtgggaccatgattagaaatttgggtgatctgtctaaaaaactcatactcttaactacattgctctcctacctcccttacatagctggtttcaaagctgtggaattcaaaggataaattaatgaagaaaacaagcggagctgaagaagaaagtacaatatggtgctgtcttcctaatgaaataaattcactaaatggacattaagctatttttatgattcacattatttaaggaaattatttccgatctttaatataaacacctttgaatacaccagaaatttcctgaggcacttggtcttaagtcgatattttgtaatggattaatattttttttacattttatatcacatgcaatctgttgtcagtcaccttcagagagtcttcatgacattccttaattagtcaaatgtttattgagtgcgttctatgttataggtactgggcagtttctcaaggatctctcatttttaaataacagaagaaaggtgaaagatgttgctatttcaaatctgtcatgggtccaattgactctatgacatttgcctcttgctgcctccctcattctatttcttcttctccaccttcttttttcttttctttttttttttttactatacctcctttataaaagttatgtatttcttttcatctattctatcaatcgtctttatctctccacagcaatatatcatctatttatcattaatcaataatgtattcttttattccaataacatttgggttttgggattttaattttcaaacacagcagaatgacattttttctgtcactattattattgttggtatgtgaagctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatctttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaa

SEQ ID NO: 3107 - DNA, 1103 bp, Homo sapiens
cggccatcctgcttggccagctgaaggtttgagactcaggatggggtcatggctgagactatgagggctgctcgtgcatgaccctgcctgctggcctccatgggcccactatctgaatgtggttacccttctccccaggaccaggtgccacctcctctgggaagctttccctgcccgtccacagggtatgcctccttgttcctctcctgccatcggtttacgtgcctgtctccatcaacagaccaggagctcctgaggacagggactgagtctgcctgattcatctctgcattcctagcacttaccttggtgcttagtgaaagctcgaacctgcctgggttcccaccttgtctctgctacccccagctctgtgaactcagagtcatttttctctccccgagtggcaccgggctcagcagacactctggccatgaaggcatcttctgactcaagcaggtctagatgtctacccccaaggaatcccagaacagttgatctctctttttatttttttattttttgagatggagttttgctcttgttgcccaggctggagtgcaatggcgtgatctcggctcactgcaacctctgcctcccaggttcaagcaattctcctgcctcagcctcccgagtagctgggattataggcatgcaccaccacgcccagagccaactactaagcctgtagcagcctcccaaactgcccagtcttgttcagatgcacctccagaaacacaggggtccaaaatgccccttcccagacaccctgaggagtagaacagtgccagcaggctccagggatgagggactagctaccacattccctttcccaagcctcagtttccccacctgtaagatgagggatatgggctctgactttctgagtttggaaaataaagtgctccccaaactgggctgctttctctgcctcaatttttcttactggagagtcaaaggccctgaattactttcatctaagggatgcttaggcatgggcacacaggacactcacaccttgctggtggccacaccctcccgctgaccctgcaggacagtttggctctgtccgtctattcaagaggtaaatgctcatcccctttgac

SEQ ID NO: 3108 - DNA, 4088 bp, Homo sapiens
cctttgttaccatgattttaactgctgtatagtatttcaaatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttagggcttacaggaaatggataaatgacagaaggcagggacttgaggagcctcttctaccaggcatcacattcaccaacaaccagctcttcttcctgagttatgctcatggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatccctaggctacttttgttaaaatgctatctgctaaattgttgctattgtccattttagggtgttggccacagttatgtggtacatagcatttcaatctatagctttgtgggaagcctaaattgatgtatcctttaaaagttcaatctattaaacttgtagcctctcaatgatgaagacatgtgcatgaatacctgggagggcttgctgctctgtggaatgcagtgcacgtttttatggacagtaattacacagcattcctcaactgtaaggtagttaaattagaaatatgtttgatctccattttacactttttgatgaagttcttgccttcagctttggagtctgttggaatgaaactgtgtctcacagcttgcatctgatgtagcagattgccctgttcaagtcagcatgaacaaagctcgcagaaaggctactaggtaacggatttgagtttattcagtagaaaaaaagggaatgaggacatatctttaggtcccagaagcagcaaaacctcctagttacataacagcagggaaactaggagatgaaatctccaaaattttgtccagtctgtatgaactgcagtgattgtctgtctgctagacacttttttttagcctaattcttgttcgtttcattaccttcatatgtgtgcattgtactggttttgaaatgagcagacattgagaaaacaattttctgattccccattaggaacatatgattttcatttccctttagtgcaaaggaacaaacatcacattgaggagggagaagtgtacccttctttttcagcttaatgttacctctctttaaaaaaaaaacatttttgaaaaatttcttgactgatgacattctagaatttattgattcaatttaaaattccctgcatagtccaaataaacataatttttactcttcaagtcatctaaagagttgtgagaaagagcagtactatgtgttttatccttagagcattatccttctaagtgaactcctttcttattactgagcgtgtgtgtgtgtgtgtgtgtgtgtgtgtgtgtaggataaaattgtaatggccttaaagttgttacctggcatttttggtttcttaaaataggcatccccctactccctttacattattcattagacatgaggtgctgggttaagtgggccaataggaaaatctcaaaagcaaaatgacaaattcagattaaccacaggaagccattgtgtgtccctgtgatttgtgattcttttaaaaaaaaaaaaaatatatatatatatatatatatatatatatatgtatatctacctaagtgtgtgccatgtccttttgtagccatgggaacgtttgaatggagaaaaatggaggggcaccatcatgaggaaacaattatactgcattagtcagaggagagcgattttccctttgacttcttcctctctgaatggataaacttgtgaagggcagctaccttgtcctcctcttaacctggcttaatgtgaccttagtttgtatttccaaaaacaagcagtattaggttggaattgtatgtgtcttttctctggaggaagcattctgacttggtttagacatataagatactctgttttattcctggacttgggtgtttaaaatcagctgaggtttatcatgcttatatgaatagtgtttcccttctagatttcctttataaactccaaataaacacattcctgcaggtcagagaaagtgtttgataaaagcatagaattatggctttggaaagacaaactaagtcacttgttggtttagcaaaactggttggtgattagttggggccctcacagtttctagatgagaagcttaccttatcctgattaactttacttgctgtaactgttataccgaaaattgtaggtaggatgtccattactcaaacaaagcagaacaaaacaacaaaccaaaagcagcaataccaaatcatcactactagctagaacaatgagaaggattgaatttccaaatacatgcttatgtttaactcaactcttccaattacattctcattgtcctttctcttggataccgattgctaagataaacagacactgattaagtggtagaaagagaaaggtaaaatgcaactggaagggaaagaaaaaagtagggagaagctggcctatggatgtggctttgaagagaagacaggattttggcattccttgctaagcacgttcaatggaggagagccatgaagttttacaaaaataattatggtaaattaaaaggatattagatattggatctcagactagggctgctataatacagttctctgattcgcacaccagatgttctgccagcgaactgttgtctgggcattggaaggagttaggttttttgtgtttgtgaaaatctcctggattagtaaaaaaattttctagatataaagtggttttatttgggctcatgaccattgcccaaagtgtactgagcttttcactaagtgctcagcattggcctcctgttctcatttattcattttatgagatggacttggacatcactaatgcaaacacaggattcataaattattctgaagtttatttagtgccttgcctcaatggagcttaaagcatagcacataaattttatcttatttagccctggagcatcactaagaagcagctaggaactatggcttgccagacagattatgcttgtgccagagaagtggagaagcctgaaatcccttgtcaagtattccacaggaaggaaaggtagtctttgggctttggtctactgacctgtggattaaactctatcccttagattatcccatttctaaatacatttattcaatcagtatttctataatcacttagcatttgataggcttcttccttgatacatttaacataacgcctcagttgcatattacattatggaagaatatacgattgcttcatataacaacattctcatcaccagtgacagtgtcctactggtttgaagaaagatattcttggattatgtgttttatatctaaatggttattctgagactggttgtattttcttctcctactcgtgaaacgatgtgaacaagcattttaaggacaataaaaagttagctggttgaa

SEQ ID NO: 3109 - DNA, 1567 bp, Homo sapiens
ctgagacagacagacacacagatccgaggccccaggccaggactcaaggagcgctgaccgagacttgcccggctctcgggccccaggcgggagggaggcgaggctgaggtattcagtgccgagtgtggccttggtgctaggattcaaagaggaaaggaagaaaactttccattctaaaagaaactccacgtgaggcgaagaagatgaaatatagtcagaaaaccataccagtaggtgttaagttgataaatgatgcatacgacatcctatagaagactgtcaccaccccacctcactgatcagccctctgcctacagccacacccacagaacattcagccatttctcctgtggttcccagcctgcagcacagcgtctgcacgtggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcaggttatctccttctctttcccttttctgcttcacacttgctctcatcctctttctcaccccacatctggtcagaggagataggaaggttcttgttacctggtacaagacaacttttggaatcccagatattcagattatttccccttttcctctttgcaaatgataatactcacagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagagtccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaaagaa

SEQ ID NO: 3110 - DNA, 2434 bp, Homo sapiens
ggtggtgaagatgcttcgccccccactccgcccggctggcacggggccaggcgctaggaccccacggcctcgccagaggggggcgtggcggggcgggccggcggtatttaaattgcagccggagcgcgggggctccggtggggcagctgagcggcctgctcctcctcgggccgtgaccccggggtctggcgcggggtgggacccgggggcgggtttgcgcaaaatgtgccgagactgcccgggagaggagctgcggccgcgctgagccagagccatgagaccccagatcctgctgctcctggccctgctgaccctaggcctggctgcacaacaccaagacaaagtgccctgtaagatggtaagatgctctgcccagacagggtgaggaccacccccacctccctgccctagggtgtgctagtgccccagccccagaagccagaagttagaagagtcaggagaggaaagggaatgtaccttgcatttaatgagcacctactagaatgtttaaacaccttatttacccacagtcctgccaggtaagcaccattattctcattttgcaaaggaggagactgaggcttggagagattgggccttgtccaaggtcattcagctgggaacagtgaggctgatattacactgtattcccccaagctgtccccacagagcagtaggcccagctaggggatctagaatatatatatatgtgtggggaatttggggtaggccagctgggaggggctcctctgtgctcatccctcttggagacaaatccccttccaagctgggctccttgacttgggactgcccgctggagtgcctctcacttcttagtgcccagatcaaatgctgccatctccaggaagcctccccagcccctcccaggctggcctagtctgatcacaccttcctctgggttcctgcggtccccaggcttccccctatctcaatactgagaagactgaacatgtggggtggttggtgaaagggtccaagcctgtctcacctgccagaccatgaacttccctagggcaaggaccaagtttgatttgcttctattcctttttcctgtcccaagccagggaaactagccctaaagttcttgtgactctatgagatacagggcaaagagaacacctagatccacttgtaaggccgggcagtcactgaggccagagcctggctggggaaagggcagggcctccggaagcccctcttggacctgagactcgaagaagcttatgacacagaaccggcagctgcttcaggaggcaggaagtgcaggcagctgcctgcccgcagcccttccctgggggtgcaatgtctcctgttgccaccacctttcttgctcttcagagcccttctaagattcccggagcccagaattgcgggcagagaaggcctcagatgtcaccaaatacaaacgcacattctacctcagggagacgaggctcagaggggaaagtccttgactacccaacaggcagaggggaagcgggtgaattttggagtctggggaaatgagataagagataggaaagcactttctgaaccagcatgggaataatacacacgggaagtaaggagaagatgtgtgacccaccagggacctacaggattcgaacccagctgcctttgccactgttcactgcctggtgcctctccctactctgctttcctcccatgatcaggtggtgaaatggagttggatggcaagtctttgcttctgaaaaggaagctgggcagtgggtgtcctgatagcccaggacagtgggtgggagctctaaactctggtcaagggccaattcctccaattccctccgacggtaagtcaggcaatgctgggagctcagagctgaaggaggcatgaagaccctggaagtggagctctgagcaccgccctggacttcaagcttcttcctggactggactggagatctgggcatcccagtgcagccctgcccaccatcaggcccccaggcttctagagcaggggtcttgggcccctgaatggaaagccagtcttgggctgtgggcttggcaaactttgtgtcctggatcaagtctcaggggctggtgccccagggagcctttgcctatccagaggcagtatgcctctgcacttgcccgggggtaacacgcggggcacagcacggtgccccccacactgtaacagtcagtaagtgggtccatgatgctctttgctgtgctgaccagctgagggcccagtggtcagaacttggctggcaccaataggaaaaggaatttgcaaatgggagttttgagcccctgactgtctgatcttgggcagcccactccccttagcctcagtttcgttaggggtacaataggaacagggtgaacaatgcctgggaagatttaatggggtagggggtctctgcactcagcacgcagcctgacacagctgggg

SEQ ID NO: 3111 - DNA, 15890 bp, Homo sapiens
agagtgaaggagcaaaggggactcggccgccatgttaggagtactggggcggagccgggcagaggttttaggggtgcgcaggagtcaagtggtggttcagtggggacggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccaggtgcggtcgctcacgcctttaatcccagcactttgggggcagacgcggggagatagcgtgattctaggagttcaaccccagcctgggcaacatgcggagaccccgtaccgtctctacaaaaacattaaacaaaaaaattagctgggcatggtggtgtacccctgtagttgcagctacactagaggctgaggtgggaggatcgcttgagcccgggatgttgaggctgcagtgagcctcgatcctaccactgtgctccagcctgggcgacagcaagcccgtgtctcagaaaaggcgggaggggtgggatattattgatgataggccttctgacgtctggcaatagattccagagtaacatcggtcatggataaattttttttttaactaagtgactgaaaccaaagttaattgtcttttgagtgattttgcacagtatctcaaaatgaactgtactttttttcttgtgtcactgaaacagtgctgtgtgttctttttcagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtttggataattaagggagcactagaaaacttttttttttttttttgagatggagtctgttgcccaggctggagtacagtggtacggtctcgactcactgcaatctccgctcctgggttcaagtgatttctcttgcctcagtctcctgactagctgggatttacaggcgcatgccaccatgcccagctaatttttgtatttttattagagacgggtttcatcatgttggtcaggctggtctcaaactcctgacctcgtgatccacccgcctcggcctcccaaagtgctgggattacaggtgtgagccaccgtgcccagccgaaaatgtttctttgcaaggataaatatatgaagataaacttgccgagcgtaaatatgttcatgaatatagccacttaaggaaattcaaacatgcagagatgttcagctgtatgcagttatgtattcatgaagtattcatgtattcatgaagccttatttgatgtagaatctgagggtgctgcctatacataaacttgcttaaaggttaaaacttaaggaatgttcatcaaagtcactttcttacacctaactcctgatttcatgaatataacacataggtgcttatcaaactgaataccttggagatgagctgctccagcaccagaagataaaattcagtaactgtaatccttgaggtacctaagtgatacattttttttaagactgagccaaaataaaacagctttcctccttccctaccctctccgaccaaacttttagccattttatttatttatttatttgagatggggtctagccatgtggagtgcagtggctattcacaagcatgatcatagcaaatgacagccacagactcctgggttcgagcaatcctgcctcagccactcaagtaactaggactacaggcgtatactggggcttctagccatttatatggtattaagtgacagcttctatagttacttggtacttgtccctgtaaaactgcacagtgtgtattctcttggctcaattattagcatattctgccatttccttgtgaatgttttgtattttatataggaaaacttaagtttttaaatatcctgaaataactgaagaattttgtttttgcctttaagtggtaatgtataaagtatactattgcagagatacttacagagtgctttcattgcaattaaaatactgcagctaactagcatgttccatatgtgtaatctaaatgacatactggtcatgtgctatttctatggaatactaacagtagtatggtacagcagtctcaacagtttaaagtgttattttggtgataaactgtttacatttatttgttttttactctgcatatctttaatgttgggcattatgcctctttcttgagtttcagtcctatgactgttccattttcagtattcatgtttatgtgtctttctaaaattgttttgcttccttgctgctcttgagacaatttatgggcaaattttgttacttttcaactggccgtgtatttccctgtgaagagttgctggattgtctcattttccagataaactgaattaatgtagtagtgaggagaagccagatttcagaggttagtgaacaaatgggaatgagaaaagaagtaggtacttaaacttttaagaagtttggctctgaaaaaggcaagaaataatgggttagagagggcaggattgtaaggatttaagataggagaagaggcataagcatatttaaatttccctacttaagggccaaaatcatactgtacctcagtctgaactttttaaaggaattcaaggacacaaaattctgccctgccctgaaatccagtcaggaggaagggagaagagctctgaagtacttttgtaattttcttctacataataattgatttttgtttgattatttttctttcctatagctcctgtttgccaggtttttcatagctgcctatttaaccaaacttgtactcccaagaatagtgcatatttatgattcttaattccaaaaacacatggcaatgataatgtctctgcttcttttgagaaattaacttggttctgaaagatggtgtttgcttttcacacctgtatcattaatacttccttgccaaacctaactaggatcctcaccaccactgttagagaaaactgatgctcagttgaaccagaatgttaaatgtgaacaggatttgtctgtgttgttgcccagctatgtttatccatacacattacctggaggaagagaaatctgagataattgagttgattagattacttacatgaagatggtttaattgtatcaatacagaaaaatgcacaaggaaagaaactgacaccttaaggcaacaaagccctccataaaaagtaaccgaattttgagagttacgaactaatgtccattacctgaagtccttctcattccattacccagtaacataaatcaaattcagtaaataagctgctttatgtcttgagaaatttaactggcagaataaatggaaagaagtcagtaaaaagggagcagttgaacaagcatggtgtctcacaccaataaccccagcactttgggaggccgaggcaggtgaatcacttgaggtcagaagttcaagaccaacctggccaacatggtgaaaacccatctctactaaaaatgcaaaaattagctgggcttggtggcaggtgcttgtaatcccagctactcaggaggctgaggcaggagagtcacttaaaacccaggaggcagaggcagtgagctgagatcgtgccactgtaccccatcctgggcaacaggacgaggctccatctcagggaaaaaaaaaaagaaaaagctgagcatggcggcatgtgcctgtagtcttagctactcaggaggctgaggcaggaggatcacttgagcccaggagtcgtaggttgcagtggtgccattgtgttccagcctgggtaagagtaaggccctgtttcagtaaaaagaagggagtaaccaagacaggtagggattcagtataataaaagtcaaaagtagttgtttattactagagcctggcactgtaacctggtatgtccaaatgtgatttaatttgctctcaagatgtgcaccagaagaaataacccgaggcatttcaaagaaaaaacaaaatgtgacctgctagttctgttactctgccacaagttaacacattttgaacttaagtgcagagtcccatacatccagtgtgactccccaaatctcaaaaatttaggctaaaacctaattttgtgtccaagccagtgcctgcttgttcctgctgaatttaaaactttgggtccagcaatcttctatcgctggagggagggagaggtatgaaaataatgtttaatggtaattgtttattgtcatgggcccatattatacccagatttagagagctatttgacacacctgtaacctaatgtttattttaacttaatatctgctcagtcaggtaagagatgcaacttcacagaggtccatttaacgtgcctaaacctaagtagaaacacaaaagctatgtatagtcccttgtttgagataacactaaatttttagagaatagcttggtactgtggtagacagagttcacttaaaatgcatttaacaatttacagataactggaaagtaattcattcatcttagaaccctggtagggacattctattaaaatatttgtgtactagttaaagtcaaaatagaaatacagcctatcacacggtatttatactatgcattatgattaataaagccacctaaggtcgttactccatgatcatgggaagttgttagtcattaagagttcgggtttagcaacaaaaatcttgcgtttgaatctaaacacattacatgattttaagcatgttcatcattctgagattaaataaaaattaaggaaatatatgaaaaatgcttaataagtacccaaaaggtaatatggtgtagcaacttagaatgtagacttcagagccagtcagctaggattaaaatgacacttcggccaatcactgttgactataagcaagttatttaactctgcctcagttttgtctgtgaagtagggataaaatcttcctcgctaggttgctataagaattaaatggatatattaagtactatcatgtgagatcactttatttgaggctaaaaaaattttttttaactaggattcactgaaaatacatctataaaaaagccactctttatcatgagaagtatgattttctgtaccttaggtgttataaagcaatatcccctcagttttaactttaccaaaatacctgtcttagtaaatgatactatatataccaaatattgcatatgtgtatataaacttcaactgtctacttctatcactgacagtttaaaaattgagataaagtaagtattatctgagtaatataaccattttctatttatttatttatttagaaacagtctcactctgtcacccaggctggagtgcaatggctcggtctcagctcactgcaacctccgcctcctggattcaggcagttcccccaccccaccctcccgagtagcagagacggggtttcactgtgttggccaggctggtctcgaactcctgaccttgtggtctgcccgcctcggccccccaaagtgctgggattacaggcgtgagccaccgcacccagccaatctaaccattttcaagatttgatctgcaaatacctgaagtaagtacaagcactgtggcccagttaaagagtgttagaactgtaagaagtccaaaggcatagctaagaattgctttagagtcagttgtgggttctgaattcttgctctgatagttagcaactatgtctactttggcaaatttaggttttgaagccttccatatctttaaaaggaggtaacatttaacagagcaccaaatacaaggttttctgtaatattagttccatagcatggtctgcaaacttccaacatcagaatctcctgggatatatgctaaatgcagattctggtttcccaaccagaatatactgcttaaaaatctgagggttagttctaggaatctgcatttttttctatacaatgtatgtattagggttccctggagggacagaactaataggagatacatatatatacacacatatatttattaagtttattgagaacttacacgatcacaaggtcccacagtaggctggctgcaagcttgaggaaaagagagagccagagtctgagtctgaaaactgaagaacttgggggtccagtgtctgagggcaggaagcatccagcgtgggagaaggatggaagctgggaggctaggccagtctctcctcttcacgtttttctgcgtgcttatattctacctatgctggtagctgattagactgtgcccaccagattgagagtgggtgggccttccccagcccactaactcaaatgttaatctcatttggcaacacccttacagacaaacccaggatcagtattttgcatccttcaatcaagttgacacttagtattaaccatcacaatgtatgatttttaaaatctgcatttttaataagctactagtttatttttccacctaatccaattcctaattttatttgaaagcaccaaggtaaatagttcctaaatcactgttatttaaattgtgctccagtaccccttattcttgctgcaattccaagacagagataacaaaaatttttttttcaatgttttgtttttttgagacagagtctcgctgtgtcccccaggctggagtgcagtggctcgatctcggctcactgcaagctccgcctcccgggttcacgccgttctcctgcctcagcctcctgagtagctgggattacaggcatgtgccaccacaccctgctaattttttgtatttttttttttagtagagacggggtgcatgctgcatgctccgcctcccgggctctcgccattctcctgcctcagcctccggagtagctgggactacaggcgcctgccaccacgcccggctaattttttgtatttttactggagacgggttttcactgtgttagacgggatagtattgatctcctgacctcgtgagccaccgcgcccggcctgccaaaatttttaatgtttgcatgtacatagttactcaacaaagaggccaggtgtggtggctcacgcctataatgccaacactttgggagggttgcctgagcccaggagttcgagaccagcctgggcaacattgtaagagcctgtctcttaaaaatatatattttggggagccaggtgtggcacctcacgcctgtaatcccaacactgggaggctgaggtgagtggattgcttgagctcaggagttcgagatcagcctgggcaacatggcgaaaccctgtctctaccaaaaaaaaaaaaaaaaaaaaaagtagaggcatcgtggtgtgtgcctgtggtcctggctactgggaagtctgaagtgggaggatcgcttgagcctaggaggtggaggttggagtacgccaagatcacaccactgcattccagccttggtgtcagagttagaccctgtctcaaaaaatatattttaaaatgatattaagtaaagaatatagtccagccacatgagcaagtattgcttatctagaaagacgtataataaagttcttttggggagataaactatgatccattctatgtttcatgtaaatcaggggcagccaatcttctggcttccttgggccacattggaagaattatcttgggccacacataaaatacactaacactaatgatagctgatgagtttttaaaaagaatcacaaaagcaatgttttagcaaagtttatgaatttgtgttgggctgcattcaaagctgtcctgggccgcaaggtggaaaaaacttgatctaaagtatttgatttttttagaaaagtttttgaatggccaggtgtggtggctcacacctgtaatcccagcactttgggaggccgaggcaggcggatcacgagatcaggagatcgagaccatcctggccaacatgctgaaactccatctctactaaaatacaaaaacttagccaggcatgctggcatgcgcttgtagtcccagctactcgggaggctgaggcaggggaatcacttgaacccaggaggcggaggttgcagtacagtgagccaagatcgcgccactgtactccagcctggtgacagagcaagactgtctcaaaaaaaaaaaaaaggaagcttttgaataagaagcaactctacagtactctattgtagacaaccaaagtattaatatttggggggcacaatttcaaccaactttaaattatttcattctggaagtatgtgttgagtaaatatgaagtataaggcccctagaggtacagatggctatggccgtctaaaccattttactcttaacttttagtgtcatggacctctttgtcaatctagtgaagtctatggaccgcttttttttaaaaaagcctttaaacatataaagtacagtacattgaattacaaaaggatccaagaatattgaaatagttaccaaaaaaatttgatatagaaatatatgtggtttattaatgaataagatctagcagtggccttactataatttcaacacagtagcgtggtgagcataaatatttcaacttatctgcaacaatgtgatatggaaataatcagtttaattgtgacagtcacatttactgctaactactgtgattgactggctatgtttacattttattagaagttattgaaagtagagatgtaacctttaattaatctataaactcctaattaagaaccctggttaaaattttttaataggactccccaaaagctgatgataatttaccttctaactctcccttgctgcaaaatgactggctcataaaccactaagctgccttggcagccacttgttattgttaccagtaggtaatatgctgttttcttctgcttggcacataagcagtaggcatgaaataattgcttaatggataagtaagttgttaaattataaaactctgatggattgcttagtcctttaacaatttacacccccctcccacttatccaattcttttgtgacagattttgcactagcaaagtgcactgtttcagacaatcaaggaaataaaacatttcttgatgaaatcctacctcgcctcaacaggaaactgaattggagtcctcaattctcagtacatcagaactagtgtgtgaaaggatcaggagaggaccatagtattggagaataaaacattatgtattgatggttgagctttatgtcatcgtgtagtaaatgctatgaccataaagccattactgttaacacttaagtttatcttctgaaagaagcctatgaaatatctccagaaagactaggggattttcttctgtttgtttgtttgtttgtttgagatggagtttgctctgttgctcaggctggagtacagtggtgcgatctcggctcactgcaacctctgcctcccaggttcaagtcattctcctgcctcagcctctggagtagccaggactacgcactgcgccaccacacccagctaattttgtatttttggtgcagacagggtttccccatgttggccaggctggtcttgaactcctggcctcaagtgatccgcccacctcggcccaaagtgctggccaccgcgcccagtcagacttgttttttagtgaaataaattgttttcctttaggaccttattctttatgataacagattccaagaatatgcagtcttgtcaatggctgtttcatcctcagtttctttaaaaataaaatacaattagaacatttttagatatgctatatctatccaatctattttcctgtcacccagtaaggttttctatcatcagcacaggtctatgaaaggacagtaaagggtctcctgttacataccctagcactaatgtttgtaatagaatgttaagataagttgtttcatgtaatcggactacattcagtctttctctaccctctgtcctctatttacccacctatgcatgtggcctactaattatattgactgtacatgaccagcaagttgtaagttcttttaaaagcaggagctcaaccatatttgtattcacatttccttctgcttaaaacagggctcttgtttcttcagtaaatattcattcggtatccactaggtgtcagataatatacaaggtaggttctagggattccaagataaataaacacagatatgccaatatgagtctgacagttttggcggggagaggtggaaaatagatctgcaagccaaaaaagctacagtagaataatataaatattgtaatggcaataaaataccagaactattaattttacatttagtaatcattcagtatcaattaaatgggtaaaatggatatgttggcatgaatgacatataactgaaaaaacactaagaactgtatagaaactgaattagacatatgagtaatattagtaggaaggggagagaatatttgattccaggtaggctaccaagcaggatgttttttcagcacagccttggaataaaatctgtaacctttgaaaacaatcacatttttgttcttatgcaatctttgtttttaaatgtatttattgttttggctctagtccctgaatgttaaaattttagtgtcagtgttaattctcacttatcttctccagaccttactccctaattttctcattttcatttgccccaataagtgccaaccttaccttgaatagaatagtggatttatcagcttacaaggactaaaaagtcgtcatttccaaaaacatctgtccaataagtctgcctcagtgactacatttctagcattacaatgtcattcttagtacactgatttgatctttacaaattacataaatgtataaaattgtcgcatgtaccctaaattatatacatctattatgtatgtatcaataaaaaaataattttctgtgctttttctcctgttaaaaagaattcttttctttttgagacagggcctggctctgtcacccaggctggagtgcagtggtgcaatcttggctcactgcagcccctgcctcccaggctgaagtgatcctcccacctcagcctcctgagtagttgggactacagatgggtaccaccatgcctggctaagtttttgtagagacagggttttgccatgttgtccaggctggtctcaaactcctgagctccagcagtcttcctggcttggcttcccaaagcgctgggattacaggtgtgagccaccacacccagctgattctttagaagaccagtattgcattgtgattgcctctgggcaggaaaactaaggggcatcagtagactatgcaattactttcttcctctttaaaaaagtattgttaatttttaaatttacatattttggtatacaattctatgagttttgacaaatgcaaagaatcatataaccaccgccataattgagatactaaacaattctatcacctcaaaaaaaatcctcttgagctgtctcatttataatttttgtgattaaaaatggttatttttcaaaaagtaacgtttgggccagtgcgcctggagtgcaccagtagtcccagctactagggaggctgaggcaggagaattgcttgaacccgggaggtggcgattgcaatcagctgagatcacaccactgcactccaccctgtgagtgggctacagagtgacactctgtctaaaaacaaaaacaaaaaaacactttaaatgtttcatatagttattccttattcaaaaagtatgcctttttgggttaagacagtgccatttcaaatagccttgtagaaatataagcaaggaaatgctaaattataccattattgatcattagtaccttagcttgtagtttaaactgttgaagatgtgttagtttttttcccctaaggttttgtcctctagttttaactagagagagatattaataaccgaattctagcatgatctcttcagatttcatgtagtttgatgtcaatagcagatctgaattggcttcaagtggatagagctgtatgaccctcagtcttctcatgtatagaatctatgaaacctgtgataccagtgttttttctattcatacttcctttgagtctgcagctgctgttcttctttttgttgtttatttttattagccactattcattcagtaccttttatatgtcaaaacgtttgatatttaacctacgttatttaagggcttttgtactgctgctgtactttataggtgcatagatatggtaaaatcacaccatgcctcctgctctgactctggataacatattcctacagcaggatctcatttcaataaaaattaaaagaaacactagagagaggaagaaggggagaagataaatgtggctttaaattgataagtgaaaggaactaacatttgaggatctactatgtgttagacactttataacatggatcttctttagatcattgagataagcaggtatcacaaagggagtctgcttgtattgatagcaagaagaaaaacatgccataaatcactggaattattcagaatttttgttttgcatgttatcctccattatgaggacaaagacagcataatgtctctatgtagtaagtgtttggtgaatgtttattgaataagtagggatttttatcatgcatatagtagtgtttcttaatgttttggatccatggacttataaaaattttataaaagctatggctacatccaggatgttacctccctcccctgccacacacaaaaggaaacagccaagtccctcccctcactctaaccattcccacatctatatttgtgtaaaacccatgattttaaactgtttgcagcccctctgtaatccattcacatgacccaagaactcagccctggaaacatctctgggtatccaggtagactaaaagcatagttccattaatttatagtgctatatggttctgccatgctttattggtcctttatagacttgagaaaatcacaccatgcctcttgaccattaacaaatggtcatgttcagtcttcctttttatgagtggaaattccatccaatttgcttttaggttcattaatatgtactacaaccaaaagatcagcagcattatatactttatcttttttagtcttttgaagtacaaattatgcgattttacagataaattatctcatgggtagcatatgtctggctttctaggtggaatgattcctatttctttttgtacctctccccattcagaactcactttgaggccaagcgtggttgctcaggcctgtaatcccagcactttgggaggccgaggcaggtggatcacctgaggtcaggagttggagaccagcctggccaacacgacaaaccccgtctctactaaaaatacaaaaattagcctggcatggtggcacacacctgtaattccagctgctcgggaggctgaagcatgagaatcacttgaacctgggaggcagaggttgcagtgagccaaggttgcagtggatcaagatcacaccactgcactccagcctgggcaatagagtgagactctgtctcaagaagaagaaaaagaaaaaaaactcactttaaactctgctagaccattgcccttgtatgtgaaattttatctggatagaagaagatgaggaaaaaaattttcttgtcttttagtggaggagaatgacatgtaaaacaagtattctttaaaaattccaaatatgatatgagaactaccccataaagttgtgaaggtcacattggtgaaaggaaaactaagtgctgtgtaaattacaaagttgtctaagtatccacctggtccttaccttgctatagaatcttttttttttttagacggagtctagctctgtcgcccaggctggagtgcagtggcgcaagctccgcttactgcaagctccgcctcctgggttcatgccattctcctgcctcaaccgcccgagtagctgggattacaggtgcccaccaccacgcccagctaattttttttttttttttgtatttttagtagagacggggttttcccatgttagccaggatggtcttgatctcctgacctcgtgatctgcccacctcggcctcccaaggtgctgggattacaggtgtgagccaccacgcccagcctaccttgctatagaatctttaggcctaatatagtctagccagaacagctatttggatgcttgcctaatcttcaatactggtttcccttttatacatgactgcaaaactgactctcacctaggtttgtgatgttagaaactccagttgtttactattattattaaagtgggaaacggagttcgttgatcaaatggattaatgttttgagtacttactatacaccaggggctcttaaatttttacataaactttctggatggagagtgatagaatctccattgttcacttgccacaagccacaccatttgtagctaacatttgaatgcttactatgagcaaaggcactgttccaagggcattacatgcacatcattcatatttctcatttaatctttataacaactccttaaaatactggtagtattcttgttccctaatttgtcaataagaaaactgaaatttagagattatacaatttgcccagcactattggaaagctgggactttgaaacctggctgatttgactccaaagtctgcactctattccaacagactgccagtgcctccagaattaattagcattaatattttctgttgtttatgatctaagtatggctgtccatggcagggagttaatgagggaggcattaatggggaaacactggaccacttctgagagatgtggtgccctccctcacaaacaggtttcttgtggtgaaatcaggttggaaggataagagaggctgaagaaggtggaggtggtgtagttgggcctgtttaggaactgattacatctgagcctctggccctttttcctgccagctgactcagagctggcagatgggccaaagtccaggcaggttgatttcatgggctgtatacttcaaaggatctgattcctggtgctactaagcacattgcttttccgaaggcacagtcttgtgggggagggaacaggatggtctccatgaggtgtttgtgaaagccctaggcaatgtttgctctaatccaaatatatacagcttgttttgagtttggcaataaaacacagagccagccctaagcagggctgaaaactgagtatttaaaccttaagtattctgcaatacaacaacagttaagtatatgggtcctagagtcagatagaactgaaatctaatcttgacttcaccactcagctgtagataaattactagacctcagttttcttgttcgtgaaatggggattttagttatagagtacctacttcatatggttgtcgtgaggattaaacaaaaatgtataccacagtacctgagatgtagtaaacactcttgaaacattagtcattattcattttttaaatttttccttcaaatactttcctatccaatagtcattattcattgaaaacttctattttataagacgatctcagcacttaaacaaaataaattgattcatcatgttttcacttaacaggcattcaaaaggcatttattattgtgttgggtagatggatggagaaaatagcaataatttttgttgaacacctaaaatgagccaaactttttaaaaaatattgtctcattttatgctcacaacagctctatgaagtattttcctatattatagatgagatcatgggccaagagaggattagcaacatgcctaagatcatatagtcagcactgtctaattctgaagcctatgaataaggtagcatttatccccacggaagcatggtattcagcaggcaggcagacacataaacaagtacagctggcccatctagcctcacgttctgcatccatggattcaac

SEQ ID NO: 3112 - DNA, 2005 bp, Homo sapiens
cacagcaacatctaaactggtatttgaccaaacatctgggcatcatagcctagccaagttgaaacaaaaaattccatcgcaaagatgctgatgctgtatgagaggttaggagatttaaactccactctaatggaaatgacccatggagataggtgctgaagtttttggtctcaatagctgtctctaggctaaaatgtcttagctctacgttgccgttctttgagatactagtgtcttgtgtttatagattaaatagcttggctgtataagtactgaccaaaaacgtattagcttttccatagactctgaatataaaatacatttagcgactgcttcagtgttcacatagaagtaaagttatttttaaattaacctttgtatgtttttccagccttaatgtctttatatgagttcaagatgatgaacagtcttggtataacgtgaaatcatttgtgaatttggataagagcagtatatgcctattcaaaaatattattctaggtatctattatataacatggttacagtataaagctttttgttgttactctatacagctaaaactcatgaaatactcaattacagttgttagttaaatcaacaaaagcactctagaaacactgccaattagcttgctcagataagttttaatttgcatgtaaaggatgttagttaaatgtcaattgcttcctcaagatgaattattgctatttctctgtagttaactcgaaaacatgttgcaagaattttgagagaattttgtttagacagtaagtcaactgcatctattcaacctcttttttttagatttagcaaagtgagccaataattgtgtcttttattaaattttaatcaaatatttaattgcaattttatgttattgtgaaaacatatggcatatgatctagtattcagattagtattaataactacatttttgttgctgattttcaaatatttgttacatgtagaaaaaaatgggatttctgtctgcctaatgacattttttgagttagtaaacattttattagaaacaaatactgaaaatttccatagtacaaggagggtaaaatgttcattgtcttcttgaaaggtctagacagaaatcctaagactacagattaatatcatacaattgaagatgtttaaaactatgtgatctctagcattgttctgtgttttgaatataattatcctgtgtacattgatcttgcaagctgaaatagtaataatattagaaaagccaatcaataattatattaaaatctgagatttgctaagatgaagatgtaaagttctctggtctgttataattgtaaatcactctttatacatttttattatacttatacccacctctgttacagaaaccacattttttttcccttcaaccccttggcttgtggttaattggtgcttgattgtttatttatttatttattttgagatggagtctcgctctgttgcccaggctggagtgcagtggcgcgatctcggctaactgcaagctccgccttacgggttcatgccattctcctgcctcagcctcccgagtagctgggactacaggggcccgccaccatgtctggctaattttttgtatttttagtagaaatggggtttcaccgtgttacctaggatgatctcaatctcctgacctcgtgatccgcccaccttggcctcccaaagtgctaggattacaggcgtgagccactgcacccggcctggtgcttgatctttatagctgaaaagaatagtgaaatatttttctcttccacaaaaatacttctgaatattgctttcaaaaacaaactttcacaaaactagtttttgcctcctaccgttgttaattgattcaacaagtacttattgaacacaaatgaggtcaaaatctattatggcatctattaaaaactgttattggctaatatccacaggacaaaaagataaaaaataaagtgttttaaaaaattctgccctatctattgcattttctgacctggat

SEQ ID NO: 3113 - DNA, 8731 bp, Homo sapiens
ctctgcgcctggcccggcgactgcgggcgctgcggtccactgggtccgcctcttcccggcatgggtttctgcccagctcacccgctgtcagctggggtcctgctctggtgggaggaagaggctcagacgcttccctgccctctcgcctcaaccacctcgaggcagcggctcccaggatgtgcactttgacgactaaagctgagccggcgccgccacgaccttgggcgggtggtcggcctctgccctgagcaggaagtagaaagtctcagcagacccttcctgagggccgagcaacagtgtagtggcgtattccacatagcaaacagatgtacactagattttgatggcatttttccagggaccctgggagcatctgtgttctcgtgttcttcttgcctgtgaggcctcttctctctgaggacagatggtaggacagagagaagacagcaaatggaaaacaaaggctgctatttttttgtggggcagcatttcttcctgtgacaatatggtgtaagacaaaattgtggcctgccatgaagttgtgagagaaaagcatccctcatttcttcaggaaaggccactgccgttccctccggctcctcttctcaggagtttgtgcattcatgaggtgaattccttggaagatgagggccaagtcttattcttctcagtctcttctgcatctagcagaagaataatggttgcacagaaaatcttggttcagtggttgagtgaatgaatggatgaacaggctcttgcacacaaagaagagacatgatgtatttgcatccttccctgcttcagccaggtccccagacagtcccggtgtgcacacttccctgcttctgttcatgatgttctctgaacctgggatcacctttccccttcctcttacctgcccgatcctacttgtcctcccagattcagttttctgaagctcagagggacaccttgtattgctggatgataaaaacaggagcaaagtgatgaagtgctgacaaggcaacaatagaacatgagagattcactgctgtgtaggaagagatcttcggtgaccatgtagcctgaagctctcattttgtcatcgagggacaccaaaactcagaacagtgctaagctcctacatcctgttctggaaggacaatcctgagcacacgatgagccatataaacttcagactgacgctgagtgaaagaatgctggaaaagcatcacaggccagggcagcaaagtcttcaaggtcatccgtgctctgatgatgtcacgcttcttccctgtctggaagacatttccccaagagcataccaccaacatcagggaaatggaatccaactggtcgctgcaaagtttgctgagcacacagtgataaagatggcaagaaggtcctgagagaaacgcaatatttttgtgcagaatgggatgttctgcctttgtcccatgctttgaaatttaccacatgaaaaataaaattaaatactgatcatcatatacgtttctgttatattaggattagagacaagttctgtttagaaataactccaagaacagtttttatattttgttttcacattgaaaaatcagtcagatttgctttagcttcaaggaacgtgtttatgtaaaattaaatgagcgctggcagtgagctagctgcagattttttttttctaaatgggatataggacagaaagatgcgttcgcggccatgaccaggctctgggtactttacaaatgcccagtggctgggcatggaaggaatacattgctgggggaagttaaaacctagggctttctcgcctgttgtcttcctgttcccgtaagtccagcaatggctcaaaccaatagtgtagccaaaaaacaaaaggccctgataaggaaagccaggggttgggggacacctcagaaaaacagagcaggggaggtcagaagaccttggaggcagaaattctgtaggatactgacaagaggccaaactggcagccaagagaggtagctgaggctctgagagacaaggcagatggagcccctgagcctgggggtccctggctcttctctattaaatattcctccaagaaagcaactgataaagggaggtcaggagtggccacagaaaagacaaaggctgggcctaagactgaagttcctacaggcaacatggtgacttctgccaacccactggaatgtctggaagaaataaaggccctagtcaggaatcaggcatctgattggagatatgatctgatatgcagaagccagaagatactgtccctggcaggggagagtggtgaccgcccaatagacgtcccacacacttcttttggccaactggtaagggagaatgctgtggttaacaggaggatctcaccaaccctgggagagggtctgggaagcatgaacagaacaggtggaggtgagtgggtcccaccaaagatgggcagcaaaggccctggggctacctcagtgggatctgccattaaacatctgtgggactctttctgtatatcttgaaggtggaagctaagtctctgaacacccactgcggacagcagtgagaaccaccacctggggtgagctaccttcatctctagtggtggcataaagtctgaggaagattggagacccagaaagaaggaaagagaaattggagaagaattcctccttctggtcctaaaactctgaactgggagagagacaggctatgggagaagattgagatggattagagaattcctcttaaggacctcttccctagccccaaccccaaacatggaaagaaaggaagatcctgagttccttcaagggaaattctaggcacctagctagttctgagaagtaaataagcaacttgaaaagcaagaaggtaacagtagcttaaaacaatagccagggaagctagaatcacagaatgtttcgttcccctacaaaaactaaagataacatcttaccatgtctctgagttgcttctcagaaactgggaccccccaccacatggatcttcttgcatgtagacctcagataagggggaattggggactgaactcagcactgttctttgttctaaatttctttctgagaggcctggaggaagtcataaccaaccagagtaacattcttttgcactgaccccaaatttttaaacaaaacttctcttctttaaccaattacagaaaatctttgaatctaactatgacctgtgagccccctgcttcaacatatcccacccttttcggccaaaatcaatatgcgggtgttcagagacttagctaaatcagtattgatttgtggttttgtctgtaacttctgctttcctgaaatttatgcctgcctttaaaaatctttacctacaagccatatggggaaggctgggacttaagcattagctgctcgatcctccttgcctggcaccctgcaaataaataccttcctttttcctgctatgaaccttggtgtgggtatctggtcttactgtgctgagccaatggaccccagtttggttctataacaagataatggttattttcacacttacacagtagagagcctcactgccttaggagcagatactcctgaggcaaggcagatcccaaagatgctaggatgaactagctgagtttgtctaggatatgccacatacatggcacccagagaatcctaccttgtcctataagatgcataaagatgggctcaaataccaattcaaagacctgtggacaagaaaaatcacccctacaatatccacaaattctaaaaagacttgcttgttgtcagccttggcttttgagttcctgcttccactgaattagttcagtttctgactcagctcttcagtctgtagatgttgtctttgttttacatcaaagtgacccacatgtgggacttggcctatacacttgacttccactaaaaaagccactcgtactcaatgtgaatgcctgtaaagcagactgtcctgaaggggttaggaagctgtggagatagttacatcagaacagagcaaatgactttggaatctgaagcagacctccttgttcttagcagttttttggcctctcaaccacgtggcttgccatctttcttctttctccatcaccctcccaataaatcttttctgttcaagttccattgaattctaattcagaaaagtttaattatcttctaatgagcttgtcttcagctaagtcatgattcagggtctcaccttctaaccccagatgtttatcagggtcttttctttaacaaagacagtcctctctgagaagagggttataatttttttcactccattaagcctgaatgaaggttgactacagaagagaaaggatgctgcttttctttgctgacctgggagaagatagacttttttagcccctgtgaaatctgtgaaggtggttcaagaagcaaagattgaaggatgaggtcttcacccttcctctacctggagaagttttccttgtgctggtgagagaagacatgtgcttactttatcttctccaaagagcagggaatgactttgaacttgaggtgggtgctttttccagagcagatgttaatcaaagcagccaaccctagttctggaagtcatccttgacaaggcatttcttttagtaaaattcaaacaaaatttaaaccttcactaagaaaaggaaacggagtggttcagagttattgctatgactagtgtcttgctaagctaccctagaaaaagggaaatggaccacctgtcccctccattctttgcccactctaggaaatacacaaaagaatagaaaggacttaacagttgtttactggccagtctctgtactgaatactttggatatatgatcaatctaatcttccgagagaagaatcttcaaaatttctccaagacatttgtccccattatatgtgtgaaaggaaaataaaaactcaggatctcaattcactatgccaaaggaaaaaaaattaagctaaaagctgagtcatgcaagaagctgcctttctttttgtttctgagcagatagctgcagataagaggttaaatatctccacaggcagttagtctatgttcactttatcttatgaaaagtgccaatttactgagcacaagatgaatacataattgactattcctctacctgctccttttctcttgcaatatagggattaccatacccttcctctttcccctccagtccactttttccctttaaatattgatgtcctcaaaatcacctttggagaaaggcacagaccacagactatttctgtggctctgtctttatttattctgggcatgtccttaaccttgacaaaataaacttctaaattgattgagacctgtctcagatattttttggcttacaaattggcggctgacggaagggactctgagaggaggtgcccctgacctttgacaaatctcttaccagtacttggttccagcctaggttatctttgttgctcaaagataagacaattttctgaggtctgggagcaactccctctggagaatccctgatcaccccaaatttggttgagatctaaggtttattttgaagtacaactccttttctggagttttactcacttccaacaaaaaaggcgagttttcctgtttccatgacaatggatggcaggcaactcctttctggagtttcagcttgtatccaacagggaaggtgagtttgagtattttactgcttctaaaatggtagagaggagtattgagcctgggcgccactcctaggtaagtagctgaattggagttttgtcttgaaaatcctgcttaatgactaagagttaagattgacaaccagctgatcttaatttccttttaacactaaagtgctcagtaatcgcattggttttgttgttgttgttgttgttttgttgtttccttattattttagtctttctcacattggattcgaccaactctaccttatttggtcaaatccaaatgagaatttcaagttatggtgaacaatgtttttgaattggctaaaactcctcacagctgcaaaaaagaagaaagaatcatacgcttggtttcgttagcagcagcaaatctatatgagtatgcagcaacttgattcttgcctcctcagaggaaagaattcgtctgaggggcataaggcagaatgagagaccacggcaagttataaagcaagagtgaaagtttattaaaaagtattagagcaggaatgaaaggaagtaaagtacgcttggaagagggccaagaggacaacttgagagatccaaatgtaaacttgggtttttttatgttggcatgcttccgggctcttgtgtctcttctgccctgattcttcctttgggatgggacgtccacatgtgcagcggcctcccagaacttgggaggggccccagccacagtgtgtttgctgaatttttgcgcatgctcacttgaggcgttgttctcttaccagtagagtgttcctagaggaaggtcatatcccagctaaactgccattttgcctcttagcatgcgcatgcttgactccactcacccagctcctgagatcttattgacagcagctgatcaccagcttcaggtgttttctatctattgggagaccacctttccctgctgctggctttgaccaattgttttggacagacagtttaataactgcctgaccatcacttgacagtctcctggcagtcctggttgaggggtagggcactgccctgccttgcttatgtctgcctaactacctactcaaacaggttctctgttcacttcctttcttaaaagattgttcttttgtttacttttcttccattctattcctccttccccttttgccatctttggtaccaagcaaattcaaaacaaaacatagagaaggcttctaatcagaccctttaaagaactcagaataaaggtgccactcaccctttttcggggtgtcctgctttctttgtggagtttcaaaagtcacgggcagatttttctcaggtctaaagctctgctttcttgtattgcattacctgatgtctttgtctttggtgggggtaccagagattaccttgtactgtgagagaatttggccttggtgtgtgtagtggtggcagagaaccacaatcttagggatggctaaggacagtttataggaaatggtcattactacagggggctacttatttctttgtacatttaaattaagaaaattgtacaggctttcttggccctattccttaaagggatctaccataaagctagtaatctaatcaagctaaattgaaaataacacctatcaaactgagtcactttaataaaattctttgcaaaggaaatttacatctttacaggaaatctccacttagtaagagcttctgggtccctacaatggcttgaagttcacataaaagacattgcctttgtttagatctaagcgtgtgcctttgagatgtacattttctacactgtttcacctaagtcatgtctttgggatgcaaatttacagttgcctcattaacaattgttcaggacatggaacagataatcatgagattaacagtctaaaatagagaaaagttttgaaaacaggcaaatgagaacttttaaatctgtaagatctgcctctgtctgggtgtctattatgtctatatgttcctatgtctcatgtggaaataatatttcactatcaattatgtgaaagagctctaattaattggcttaaagaaaagtcagtgttcatcaacttaatagaagctagctcagaggcttttcagttcacatgactttagtaatctttggtaagattaatttggtaaattttgtctcaaaatcctctccaataatttaaaatcttaaaggcatgttaagttaaattaagtaatcctaggttttttactgggaattagagttactaaaagttagattagtaggatagtatgatgtgtttttggggaagtttataaaaacatgaggatgtggtttttgcttaagaaaatgtaaatttttttctagttcagaggacctttctactgatgttgagagaaaaaccatgttcgcatccaactgttttttggtaaactggttaagtttgtattggtatctcatggctagagttctgaagtaaaagctataggatctttatttgtatgagtgtgtgtgggcttaggtgtgtttatgtatacctacatgtgtattgttatgtttatggccacaaggtaccaaactggcttaaaaataaaggagaactcacaaattcagtaaataagcccagttgcttttcaagttaatgtgacttaagtagagttttaataaataaactggctttaaaattattggtaaaataaaattagaaatgtgttcagaatcgccaacatacattattgtttagatttattggtcaagcaattttatatttttttctcttaaatactataaggtgtcaagatttggcatgagggttgtaaagctataaatgtagcccaaaagagaattatatttgtgtaacttttcgataaataaagcatttaatattgttggtttaatgaaaatagctaaatcctgagttattgaccaaaaaaaacccaaaacatttatttaaccttaatattcttacttaagtaaacacctgaaattcacagcctataaaaattgttaacagggaaataactctaaatgatgaccatcacagttttcatatgtaatctagatcaactatttaaacaaattaaataggcaaatgtaatagaataaatgcttgtaaataaacttgtca

SEQ ID NO: 3114 - DNA, 440 bp, Homo sapiens
caacaatccattggctaacgaggtcgatgacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtaatacgaggaaatagtatcatcatgttagaagccttggaacgagtataaataatggctgttcagcagagaaacccatgtcctctctccatagggcctgttttactatgatgtaaaaattaggtcatgtacattttcata

SEQ ID NO: 3115 - DNA, 313 bp, Homo sapiens
ctcaattattctacaatagaacactggagagaaagagatgcaggtggggaggaaggaggcaggaataatgggaataggtggaagagaaggcggaagatgtatttatccggatacaatcaaagaaccatttcagaggaaaaaggagaatgtgaggctataatgacaaagcagccatctgcacaccaggaaggggcactcaccagacatcagagctgccggcaccttcaccttggacatcccagcctccagaactgtaaaaaataaatgtttgttgtttaagccacccagtctattttaatttgttatagcagcc

SEQ ID NO: 3116 - DNA, 1911 bp, Homo sapiens
aaaaccctgaaggatggttctcaaaaattctaaaggaaccacagggaattccttttaagagcaacagaaagcaagctagctgaggcttctggactttttgaattctgaaaccaaaagaagaataagtcgaagaaattttactttggtatgtagaagcgttccaatttgtttggtctaaaagttatccatggacttttcttcagagtgctctgtttcattcgatgtagttaaaggttgatttcaggtaatttctgagatgtgatgatttggaaaatgtagcacataaaaatgaggaacttacgcgttaatggctttactttcaaaatgcctatgtatctttctggcatgaatttgacttggctcatcacagctctgatatcctctgcacattgaggtgttgtcgttactacttaatatttggtctggaaaaaatgaatcctgttgctaaagattttgttggtgggtagtccacagcagaacgattgctacgggaggtgctggctgtgtaagtcatgagctttgataatttcagtgcttaatgtacagctgctggtcttggtaaagtaccacatgatggctcatagttgcattcctagttgaaactcagcacaactctggattctgattgttctacaaatgaatgagatacaatagtaaggaaatccacagaatagtaaaatagaatgttgtttgttggaattcatttctgtggctgtaggtagaagacgatatggcaaattcactcaccagaaaattgtactatgagttttttgtttttgtttttgttttacataagagaaaagaaggtaaaaaaaagagaagagtttgaatgtcaagttttgttggacgcagaaccaagttaccatttgctgttccggagcctctttgctgtccccataggaagaaagtgttcacaaaatgcttttaatcctaggagcattccgttgtctagcaaaaacatctttctcactggcctgaaatatacaaggcatatttttgtatggccatagaaatatacttttcaatgctctgatttgaaaatggcgacattgttaaaaaagagcagggacttgggtacagtggtgaatgcatgagacgttcattttgatgaagtgttgagtagactagatgcttggtatcaaatgccttgataaaatattttggaaatgagagctggtttccattaaaaaaaaaaataagcccctctggagggattgacttatgactttcaccattttgttttcatttacttcaagtagtttttaaaattaagtatacctatgagcacgagccaggcttggactatagattttcagaagtcgatgtgcttgaccctagatatttgatccctgttggtgattcttggtcatctggtgttgtgatcctcgttagcagaaccgcatctgcatagatagcactttgatgcacatcagagcccaaaacacttgaattttccaacaacgagaacatcgggtgtttctcttggtgtgtgctaatggtatggactgattttgcagaatcactgaagcaagctgtaaatgatgtatgaaatgaaaaactcctgtccagtgcacagagcgaatatatacagttctgtgtaatcactgtggtgctgggctatttgttttaatatttccttcagacatatagcagtttttttggtgagtcatatccagacacttgccattggcacatagctcaggtttctgttacatatattttaaataaatttcaatgttgtataagtgtacttgaattaatgcaataccagattttagaagacttgacctttataaaatagtatttttatgaaaacaatatcaacatttttgttctgaaaaatttggaaaatactgaagagcctaagtagcaaaattggaaatcattttatgccattatggagaaatagcc

SEQ ID NO: 3117 - DNA, 1747 bp, Homo sapiens
aggaaagaacagtatttcatttcaagctggactactcatctaccaaaaaaccattctgaccaaagaaacagatgcagaattacagtcacagctgcattctgcacagaacaagttggataatggtaacctctctgtgggtaacttctaacttccaacttacccaaatttccacctatgcccgtaatttacaagttatattatatttctaggtatactaggtttagattcactgggatcaaaattctggttgctaccagaaatactgctgttgagaattttaaaaagatagaaagcatttgacatgcaattttatagagagagtaactatgtttgtataattatattattctctaagactgacctcttttctatttagcttaacatatggtagtatcctgaataggattctctggttcatcagaacagaaaaagcagatgagttttattacacaatgttattgactaacatcagttacagtattaaagaaattattctaggaaaaaaaaaccctatcatttgattcctaataaaaaaccaggaatgacacctcagaaaatcacaaaattttatgatttgagcttctcttatagaacttttaaaacattagtttaaatacaattttgaataacaggactgaggggaagaatggggggtaaagaataaacttagtaaagcagttaagactcagggagccttcatgctatgccaaattcttccctaaggttgggcaaatcacataatctcactaagcttcataaagttgataataacacaggcctgtaaagtagtaagaaatttctgagtggaagataaaaatatcactgagtatttcagtgcttccatttactccacactataatagagatgataatattgccagctacaacttcacaggagtgtttagagtattactgagtatgcttgtgagattcttagaaatcctttgatgaaaggcaatggccaaattcacattccatgtgactccttaaatgtaaaccttttgttttccttgacctggacatttttcaagactgcaggccatttttatttttatttttgtagactatccctcaatttgggcctatctgatatttccccatgattaggttatgcatatttggcataaatatcacagaagtgatgttgcatccttctgagagcataacttgaggcacttgatcttgatgtattgtaatatcagtgatataaattttgaccattaagatattatcttccagttttctccaatgtagtaaataagaaatcttataaagagccactaatgatcattccttttatatttattagttagcattacattccaagaaaagcctttcagttctccttcctttattcatttatatcactacagtgtcacagatttttatgttagccaatggattttaagccattcctatcattatttattttgatgtttaactgtcccaaatttggcaatgggaccattcttccccttcaccctggctcctgtttaacctatgtacccataacgctttgagcacttcctacctttccagcatacacaaaaagttttctctgcaccagctttggaatcagctttttctccaatgagacctagctctttttagtggacaatggtatttagacaccaaaatctgggcactaaatgtgttcactgttacttacgtcatcgcttacagtctctctcagaggacagagctggaacacacatcacacacacacacaaaaacatttctatctacc

SEQ ID NO: 3118 - DNA, 18049 bp, Homo sapiens
taattctgtctctgctgctaacaaattgtgtggctttgggcagattactcaatcatatgtctccatgttgtcattgttaaagatgaaatattgaattagatgatcttgaaggtcccttctggttcttaagcttatgcagtcatgtgcatgtgcacatccaacccctccaaaataaagaaaataggcctgattattcaaatgatttgaactttaaagctatttacatataaaagattggtttacttgtgaattatttaaccctactctgttcgtatcatttaaaagttcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctggggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtcagttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaattaagtataaggggttgttcgttgttgtcatttgttatagtgctactccactttagacaccatagctaaaataaaatatggtgggttttgtgtgtgtgtgtgtgtgtgtgtgtgtgtgtgtgtgtgtgttatttatacaaaacttaaaatacttgctgttttgattaaaaagaaaatagtttcttactttatttttactggtatgttctacttttttgaaagttgtactgaagacttctgattttgggttgaagggaaggaaaaggaagaaatgttttttacattcattattatacttaaagcatttttaaagcattttaatagttctggatgcagaaatcatctaaaatgacagtgaattaggttttaaaaagattttagatttttttgaaagtttaatttttatttgtaaagactcctcaaggatttgtatatgcaacacagtaaggagatcttccattttactacctttcaagtgaaaaatagcctatcatacaatatgcttgatttcagattttcatactaaaacttaactacatacttaaaagtaggttcttatcaagggtctctaacattgctttttaaaacaagatgtgaactaacttttcttaaacatttttttaaatgcttcatcttttagttttatataaagaatcccacatgtacattcttgtttttagaatggggtgactaccttattataaaattccaagtttccaagagacttcttttcattgaggcttcgtaaagttttccattttgattctgactacacataaaaataagataaccctgtagttattaagttggttctgtacaagaaacaggtaagtaattattgtaccagttaatgccaaaatatttttcacgttaatattcttcagaaacaagggtaaaggtattcttagaattatgtaattctgtaactattccagtatattaagttatacaatctttatataaatgactttttccatgggtacttgtttggaaaatagtcactttttcacgctatttatatatgctgccagtaacactataatttgctatggaagagtgttcttttaacctaaggcttctagtttacagtcaagtgtaattttcatcacaactataacttctggtatttaaattttatttaaacagctacaaaagagttagcaaatacctacagttctgtatctatagagccaatcttgatggtgggtgtggcattatgtgctcactttattgagcctatgttaatttctttagcatgctccccctaaattgaaatagtgatgtagtaaatattcagaagcgattttcttttgcatttttacctaaccaaggaaacgggccacacaccttggtttagggatgttgtgatagcttaccttccagtttttaagaaatgcttcctacaactgctgtcaaccactgtattgtctttaatgaacactgttgtatcccatcctaattcttgtactgaaattatttctcatgaaagtttctctaatatttctaatgaaagtttctctaatttgggggcataatgtactaagaatcagtttgctgtatattagaataaatagtaacagtaagtcagcaggattatccaaacaaaagactaggttttatgagataagcttgatttaagaaaaaaacaattaaagtatgaatatcagaaatactgtgtgtttactctcagattttagttggttggatttaatatcaagataactagctgctaagcgtttcataattctcacagtgatattagatttcaaaatgacactgagagaactgaaaaactacatcagtcaaattcatgtatgtatatcatatagcctttaactttttacattaatcagattcttagtaaaatgcagactgtatacctaaatattaaaatatttacttttataatcttaccttttatttcaatataaataaaattcttcttaggttaaaaaattaatttcagttgtgtttatgccagatggcattgcttagttggtgcaagctctcaatatgtttcattcttttttatagtctttcacatttataaggaaaagccttatctccaactgaaacaccagtcttactactacggttttaaaagttgttaatgatcattatctattataaggcctttatttacatagcaaattgcttaacattttattttgaatataacagatttttaaaacgagacctttaaaggagctctaagagtccctgttctagttatttgtattataagcttctgtgaatgttttaattttaatagcagtagtaggaagatatatggcagtagaagcactcatatacatgctatttattgaggtaaagtaaatcatctttgagcagtgtgaacagacagaagcatagcttttagatctgaattattggtaaataacagatagatcaaggtggtatggaaaaatggtagagcaggcatattacagagacaacaggcagctaagaaggcaaattatcagttgcagatgataagacttgtcacaataagcactaaaaacacaaagtgtgaaatggaaaaatctgttaccagttatttattttcaaacacagttgtatacatagatgaaaatgtttaggtgcttttcatacacagataattaagtacatggtatttaataataaaaaagtttaaggtcctccaaatacttgaggtatatattatggaaactcagagtatgaattttcttttttttattttttttattttttatttttttttttattttttttgagacggagtctcgctctgtcgcccagcctggagtgcagtggcgcgatctcggctcactgcaagctccgcctcccgggttcatgccattctcctgcctcagcctcccgcgtagctgggactacaggcgcctgccactacacccggctaattttttgtattttttagtagagacggggtttcactgtgttagccaggatggtctcgatctcctgacctcatgatccgcccgcctcggcctcccaaagtgtcgggattacaggcgtgagccaccgcgcccagcccgagtatgaattttctaagagcatgtagtataagattgtgagttggaatttatttactgaaatgaaaaacaatgaagttaaagaaatcaaagatactaaagcaaatggaaagataaacctaacaaggcactcaataatgaaaatacttagtggaatactacttgaagtatacatatcatactttcttcctctgcttaataattttgttgaaggctgttattacagtgagcttttattggctatcctaaattttaagtatattagaacaaaatttattattatgtccttagtaacatttaagacccctcaattttttattagagaaaaaaagttgtttacagaatcaaagacttcatcttgatttttaagaacaaatagctgaattctttaacaccaccagttaacaatttttttttttttttttttgagacagagttttgctcttgtcgtccaggctggagtgcaatggcgtgatctcggctcactgcaacctccacctcctgggttcaagtgattctcctgcctcagtctcccgagtagctgggattacaggtgcccgccaccacgcccggctaattttttgtatttactagtagagacagggtttcaccgtgttggtcagtctggtcttgaactcctgacctcaggtgatccaaccgcctcaacctcccaaagtgctgggattacaggcatgaggcactgcgcccggcccagttaacaattttaatctgcataaccaaggtatataagccgtcatgtgcaggctgtagggagcccacagctaaacgacaataattggattgtattgattgatagcacttactgactacagttaagaggcatttaaaaattaaaataatagtatttcccacaaattctgccagaattgtttttttaaaggctgttataaatccttgtttctatcaataattttgaagacagtgtgaatctcatggtaccacttttttttacctttattacttttataactgctttgcagtttgttgaatagaaattcttggtaataggagtaaaggttgttgttgacaaagaaacttgaaactgagttttaccttcttattgaaggactttgaaaaatgttgaagttgaatcctagaacagtgagcataccattattccttaagaaggcaccattcatttttaaaattatttcagaggaagaaaattctaaaaattgagactttactgtacagaacaatccttttctaaaacatagtttggaaatctgagatctaaagaatgatgaacatggtgctaggaaaaaagaatttcagtttctatcatctaagatcattcacatttaatgggaatttttttcaacatctttaatttctcttattttaaaactactgtcctaaatgtggaaggtgagagtatggacaatacaatcaaatgccaaaaataccttggttctagtaattgcctaggccattctctcacagttgctccaacaacttagctgtttaacaatcagattcttagtaaaacattttttctttttcttaaaaaaaaaaaagactatccatattgcataccacttcagacttttctacatagacattcacccatcaatactgacagtgcaagctacgtacaacttcaagttgcatcagataactcatattaatggttgtagtagtgaaactgatctcctaagtatgttgataaagtcctaaatcttgttcaacatattaagaataaagaagagtagataaaccaattatggatgtagcaaaggaatcctggataatcttacttgagggtgaatcctgatggtgtatcaatttaaaattccctgttaaacattcagacaaaattagaagattacaactttcagttctgctaccgctctgggaatatgagccctaatcatagttttcagggagcctaatttggtgtggcctcaaataatctcatcatccataaagatcccagaggaagggtatgttggacctggggtagtgagagttggaatttcatatattctttctagggcatgattttttcagcagaggtgttatgcctccaagagtgtgaaaactgatgttggaggatgaaaaaatcatataaagcacagaaatacagtacataaacagatatgcagtgatattagagtgtcatggtagaggaaattagggaaagatgtctaaaatgttcctggtgggaaagttgggggaggataatgcaaaaaaaaagttgagaaacactactttagagtgtgctcatatagacataggtcaaaccagcactacctcagaaataacctcaatatgataagcagatacgacagtgtcagaaaagctaagagtactagatctttaaataaatactgagccaaaaaaaatagtttacacataatctttttaaaaagttaccttatgtcactcatacaggaaagctctggctggcatctagtgggtgcccctctgggatgaagcttccagaggaaggaacaggcagcaatctttgctgttctgcagcctctgctggtgatacccaggcaaacagcatctggagtgggcctccagcaaactccagcagacctgcagcacaggggcccgactgttagaaggaaaactaacaaacagaaaggaacagtatcaacatcaacaaaatgtccactcagagaccccacccaaaggtcaccaacatgaagaccaaaggtagataaatccactaagatggggagaaaccagcaagaaaagggtgaaaattccaaatgccagaatgcctcttttcctccaaaggatcacaactcctcgctagcaagggaacaaaactggactgagaatgaggttgatgaattgacagaagtaggcttcagaaggttggtaattacaaactcctctgagctaaaggaacatgttctaacccaatgcaaggaagctaagaacactgaaaaaaggttagacaaattgctaactacaataaccagtttagagaagaacataaatgacataatggagctaaaaaacagcacgagaacttcatgaagcatacacgagtatcaacagctgaatcggtcaggcagaagaaaggataccagagattgcagatcaacttaacgaaataaagcaagaagacaagattagagaaaaaagagtgaaaagaaactaacaaagcctccaagaaatatgggactatgtgaaaagaccaaatctacgtttggtgtacctgaaagttgacagggagaatggaaccaagttggaaaacactcttcaggatattatccacgagaacttccccaacctagcaaggcaggccaacattcaaattcaggaaatatagagaacaccacaaagatactcctcgagaagagcaaccccaagacacataattgtcagattcaccaaggttgaaatgaaggaataaacgttaagggcatccagagagaaaggtcgggttacccacaaagggaagcccatcagactaacagcggatctctctgcagaaaccctacaagccagaagagagtgggggccaacattcaacattcttaaaagaattttcaacccagtatctcatatccatctaaactaagcttcgtaattgaaggagaaataaaatccctcacgaagaagcaaatgctgagagattttgtcaccatcaggcctgcctaacaagagctcctgaaggaagcactaaacatggaaggaacaaccggtaccagccactgcaaaaacatgccaaattgtaaagaccatcgacactatgaagaaactgcatcaactaaagggcaaaataatcagctagcatcataatgacaggatcaaagtcacacataacaatattaaccttaaatgtaaatgagctaaacacctcaattaaaagacacacactggcaaattggatagagtcaagacccatcagtgtgctgtgttcaggagacccagctcacatgcaaagacacacataggctcaaaataaaggaatggaggaacatttaccaagcaaatggaaagcaagaaaaagcaggggttgcaatcctagtctctgataaaacagactttaaaccaacgaagatcaagagacaaagaagggcattatataatggtaaagggaatcaatgcaacaagaagagctaactatcctaaatatatatgcacccaatacaggagcacccagatccataaaacaagttcttagagacgtacaaagagacttacactcccacataataacagtgggagactttaacaccccactgtcaatattaaacagatcaacgagacagaaaattaacaaggatatccaggacttgaactcagctctggaccaagcagacctaacagacatctacagaactctgcaccacataattggaagtaaaacactcatcagcaaatgcaaaagaacagaaatcataacagtctctcatatcagagtgcaatcaaattagaactcaggattaagaaactcactcaaaaccacacaactacatggaaactgaacaacctgctcctgaatgactactggggtaaataacaaaatgaaggcagatataaagatgttctttgaaaccaataagaacaaagaaacaatgtaccagaatctctaggacacatttaaagcagtgtgtagagggaaatttatagcactaagtgcccacaagagaaagcaggaaagagctaacattgacaccctaacatcacaattaaaagaactagagaaacaagagcaaacaaatttaaaagctagcagaagatgagaaataactaagatcagagcagaactgagcaagacagagacacaaaaacccttcaaaaaaaatcaatgaatccaggagctggttttttgaaaaaaatcaacaaaatagatacacggctagccagattaataaacaagaaaagagagaagaatcaaatagacttaataaaaaatgataaaggggatatcaccatcaatcccacagaaatacaaactaccatcgggaatactataaacacctctatgcaaataaactagaaaatctagaagaaatagataaattcctggacacatacaccctcccaagactaaaccagaaagaagtcaaatccctgaatagaccaataacaacttctgaaagtaatgaattaatagcctaccagctaaaaaaaagtccaggaccagatggattcacagccaaattctaccagagatgcaaagaggaccagtaccattccttctgaaagtattccaaacaattgaaaaagagggaatcctccctaactcattttatgaggccagcatcatcctgataccaaaacctggcagagacacaacaaaaaaagagaattttaggccgatatccctgataaacactgatgcgaaaatcctcaataaaatactggcaaactgaatccagcagcacatcaaaaagcttatccaccatgatcaagtcggcttcattcctaggatgcaaagctagttcaacatactcaaatcaataaacgtaatccatcacataaacagaaacaatgagaaaaacaacatgattatctcaatagatgcagaaaaggcctttgacaaaattctacagcccttcatgctaaaaagtctcaataaactaggtactgatggaacatatctcaaaatcataagagctatttatgacaaactcacagcaaatataatactgaacgggcaaaaactggaagcattccctttgaaaactggcacaagacaaggatgccttctctcaccagtcctattcaacatactattggaagttctggccagggcaatcaggcaagagaaagaaataaagggtattcaattaggaaaagaggaagtcaaattgtctctgtttgcagatgacatgattgtatatttggaaaaccccatcgtctcagcccaaaatctccttaagctgataagcaacttgagcgaagtctcaggatacaaaatcaatgtgcaaaaatcacaagcattcttatacaccaataacagacaaacagccaaatcatgagtgaactcccattcacaattgctacaaagagaataaaatacccaggaatccaacttacaagggatgtgaaggacctcttcaaggagaactacaaaccactgctcaaggaaataagagaggacacaaacaaatggaaaaacattccatgctcatggatagaaagaatcaatatcatcaaaatggccatactgcccaaagtaatttatagattcaatgctaccaccatcaagctacctttgactttcttcacagaactggaaaaaaactactttaaatttcatatggaaccaaaaaaaagagcctgcatagccaagacaatcctaagcaaaaagaacaaagctggaggcatcacactacctgacttcaaactacattacaaggctatagtaacaaaacagcatggtattggtatcaaaacagatgtatagactaatggaacagaacagaggcctcacaaataacaccacacatctacaaccacctgatctttgacaaaccctatttaatatatggtggtgggaaaattggctagccatatgcagaaagctgaaactggatcccttccttacaccttatacaaaaattaactcaagatggattaaagacttaaatataagacctaaatccataaaaaacctggaagaaaacctaggcaataccattcagcacttaggcatggcaaagacttcatgactaaaacaccaaaagcaatggcaacaaaagccaaaattgacatatgggatctaattaaactaaagagcttctgtacagcaaaagaaactatcatcagagtgaacaggttacctacataatgggaaaaaatttttgcaatctacccatctgacaaagggctaatatccagaatctacaaagaacttacacaaatttacaagaaaaaaaacccataaaaaagtaggtgaaggatatgaacagacatttctcaaaagaagacatttatgtggccaaaaaacatatgaaacaaagctcatcatcactggtcattagagaaatgcaaatcaaaaccacaatgagatatcatctcatgccagttagaatggtgatcattaaaaagtcaggaaacaacagatgctggagaggatgtggagaaataggaatgcttttacactgttggtgggagtgtaaattagttcaaccattgtggaagatagtgtggctattcctcaaggatctagagttagaaataccatttgaccctgcaattccgttactgggtatatacccaaaggattataaatcacgctactataaagatacatgcacacatatgtttactgcagcactgttcacaatagcaaagacttggaaccaacccaaatgcccatcagtgatagactggataaagaaaatgtggcacatatacaccatggaatactgtgcagccatcaacaaggatgagttcacgccctttgcagggacacagatgaagctagaaaccatcattctcagcaaactaacacaagaacagaaaaccaaacaccacatgttctcactcataagtgggagttgaacaataagaacatatgggcacagggaggggaacatcacacacctggcctgttgggcagtggggggctagggagctattgcattaggagaaatgcctaatgtagatgacaggttgatgggtgcagcaaaccaccatgacacatgtatacctatgttaacaaacctgcactttcggtacatgtaccccagaacttaaactataataaaaaaaaataataaaagtactgaatcccactgatttaatatctaaaaaaatagttacctaattacaatctctagaatttaaagatctccttcctagatgcaaaaagtgcctcttttttcaattgaaatacatccccaagtactcttctgtcgggttgtttttatatagtcacaaaaaaaataaatataataatcctctcaagaaaagcaggagattttaacaatatgcaccatgttaaaaaacatttcttggttgttcaaggagataataaagtatctttcactattaaaaccatatgttatattactgtgtattaaaataaaaataaaatttcctcaaacagaacatttttgagaaataggaaagaaactaataatgccaaataaaggtcatatctttgctatgaaatttacccagaagacaatgtgctcttcttctttgacttaaaaatgctgccttttaaaagaattggaggcattctaatgggtgtgtagtatagcattgtggctttgaagtatatttttttaatgataagcaattttttcacgtgcagtttagtggccatttgttcatagttggattactacatcctatccatcaaacaaattaattgcacaacaatttgataaaatgttgacagtctttgtagaaggagcaatgtaggggataatactgccttttgctagatgacaaagaaagttgaaagtaaatgaatttttaaaaagcttgaactggatgacttttgcctcagagtattgggtgaaaataaaaagaagtgttatttaaattagacactctcaagtctagacacatccctggttgcttgaggaaaggaaccatattttctaaaaggtatcatatctgctacatgaaatataactagaagagtgctactggagtggtagaagagaatcagagatttagttgaaaccatttatgagctatctgaagaagctaagtccaaagaggttagcttgacttgctcacatcaaagatctgctcaggaacacagccaggctagagcccagctcttctgattctgattagtgctcattatacaacaacatgctaaattattttatttttaaagaaatgagcctaggttgtaaacaaaccacaaattttaatcatttaacaaatcttttttgaaagcttgtagtgaacatggcactgctaaatacttttggtgaacaaaaatgtgtcagatgtcttttcaagggattgttagttgaaaatagactgaaatgtatctttagaaagcattacaaagatgacttgcaaataactgggaaaaaacccacaacattaaatagtacatttctaaaaagaagtttattctgatgaatttacagaagcaaatgacaggtaaaattgaagcagcattagttatgcatttaggaaatatatttaatctatttaagtcaaatcaataacctgggaaatattaacctagaatcaatactgcaaaaccattttgtataaaagtgaatgacaccaactaaagccatatataagaacattcacagctatcagatcagaactctcaggcagaactcatcatattttctccaaaaagcagccaccatccctaatgtacctaatcataataatgacaccacacttatattagtcatcagagctccgaaaccctaagtaaaaacttttgactcatttttattacttgcactttctttccattctctttcaatgcttcatcagtctcttcttttacactcccccataattttgtgttgtgattattatgataaccttctaattagtcttcctaccttctctcattagtcttgcacatcactattaggtcattcttcccaaagcactattataaccatgtcattcttttgctcaaaagctttccaactttctccatttcctacaggataaagtccaacatcccagactgtcaccagtggcagagccagatattaacttcaaaagtaaggaaacctggggtggggattcatttttttttccccttaattttaagttcagggtacatatgcaggtttgttacacaggtaaacttgtgccatgggggtttgctgtacagattattttgtcacctaggtattaagcctagttattttttctggtcttctccctcatcccaccctccaccctctaataggcccctgtatgtgttgttcccctctttgtgtccctgtattctcatcatttagctcccacttataactgagaacatgcggtatatggttttctgcttctacattagtttgctaaggataatggcctctagctccatccatgtccctgcaaaggacatgatctcattcctttttatgctgcatagtactccatggtgtatatgtaccacatttttttaatccagtctatcactgacggacatttaggttgattccatgactttgctattgtgaatatgttgcaatgaacatatgcatgcgtctttataatagaatgatttatatttctttgtgtatatacccagtaatggaattgctggatcaaatggtatttctgcctctaggtctttgaggaatagccaccctgacttccacaatggttgaactaatttacactcctaccagcagtgtaaaagtgttcctttttctccacaacctcaccagcatatgtgttttgactttttaatcatagccactcttattggcatgagatggtatctcatcgtagttatgatttacgtttctctaatgatcagtgatgttgagctttttttcatacgattgttggccacatgtatgtcttctttgaaaagtgtctgttcatgtcctttgctcactttttaatgttttttcccttgtaaatttaatgggttttttcttttaaatttgtttctaagttccttatagatgctggatattagacctttgtcagatgcatagtttgcagaaattctcccccattctgtaggttgtgtgttcactgtgatgatagtttcttttgctgggcagaagctctttagtttaattagatcccatttatcaatttttgcttttgttgcaattggttttgtcatcttcaccattaaatctttgcccatgcctatgtcctgaacggtattgcctaggttgtctcccagagtatttacagttttgggatttatatttaagtatttaatccattttgtgttaatttttgtatatggtgtaaggaaggggtccagttttaatctgcatatggctagcaagttatcccaggaggatttattgaataggtaatcctttagccattgcttgtttttgtcaggtttgtcgaaaatcagatagttgtaggtgtgaaatcttatttctgtgttctctattctgttccattggtttatgtgtctgtatttataccagtaccatattattttggttactatggccctttagtgcagtttgaaatagggtagcatgatgcctccagctttgttctttttgctgaggaatgccttggctatttggctcttttttggttccatgtgaattgtaaaagtttttgctaattctgtgaaaaatgtcaatggtagcttaacaggtataacactgaatctgtagattgctttgggcagtagggccattttaactatattgattcttcctatccatgagcctggaatgtttttccatttgttcatgtcatctctgatttctttgagcagttgtttgtagttctccttacagagatctttcattttcttagttaactgtatttctagctattctaactgtgaatgggagtttgttcccgatttggctctcaacttgaggtgttgttaagtgtactgaaatgctagtgatgttctgcaaattgatcttgtatcctgaggctttgctgaagctgtttatcagcttaagaagcttttgggctgagactatggggttttccagatataggatcgtgtcatctacaaacaaagataatctgacttcctctcttcctatttgaatactctttctttttcttgcctgatcaccctggccagaacttccagtactatgttgaataggagtggggagagagggcatccttgttttgtgccagttttcaaggagaatgcttcaaacttttacccattcagtatgatattggctgtgggcttgtcatatacggctcttgttattttgaggtatattcctttcaatacctagtttattgacagtttaacatgaatggatgttaaattttcttgaaagccttttctgcatctattgagataatcatgtggtttttatctttagctctgtttatgtggtcaatcacatttactgatatgcttgaaccaacctttcatcccagggataaagcctactcgattgtgattgattagctttttgatgtgctgctggattccgtttgccagtattttgaggatttttgtactgatgttcatcaaggatataggcttgaagttttcttttttttgtatttctgccaggttttggtatcaggatgatgctgacctcatagaatgagttacagaggagttccttctcctcaattttttttttttaatagtttcagtaggaatggtaccagctcttctttatacatctcgtataattcagctgtgaatccgtctggtcctggg

SEQ ID NO: 3119 - DNA, 1183 bp, Homo sapiens
gcttctttgaatctgctaatataaggtaaaggaaattgaatcaagttatgtaaagtgtggagggaatgatcccttacagtttaggttacatcatataattctaaaacacaacggatgtaatgtgagttaaaatctgtaaacaataaagtcatataataagagattgttcattttgttatttgatctacagcacaccaaacttctggatggttgaaatttctgagcaaatctcagaagagataaatgacttctgaaacattttaagtctatcaagttcaggatgtgtttcaccattgcctgcttcctgggcaccaaaatgtaccaagaagagcctaaatctactggagactcaaatcggcattaccactgcagtttttgagcatttctggagcagatacagcattccaaaacaatccagaagtgtcacctctcctcagcccacacgccagaacttccatgtaaatgcctcatgtgggcttcccatggtgtctaacggatactttcaactaactgggtctttcttccctaccctcttccagatctatgaaaatacctgaggtttccatttctgtgcctcatttattgactatttcaaagtccagttgtttctctggaattttaacaacacaagaacgatatccacaagacagaaagacaataagggaccaacaggagacaattacagaatactcatgaagactaaaaaaggctgaaatcatcatcatttcccatatcagggagatagttacgacactggacaaatatctaatgctgcctttcaatcctgactcaacaacttactgaatcacttaaactctttggcctcagtgtcttcctgtgtgaaacagaagcagatctttgtctgcttcacaagttgtgagaataaagagaaaatgtttgtttatttgcttgcttgctttttgagacaggatctagctctgttgcccagactgaagtatagtggcttgatgttggctcattgcagcctccacctcctgggctcaagtcaacctcccacctcagcctcctgagtagctgggactacaggtatgtgccaccatgcctggctaacttttgcattttttgtagagatagggtttcaccatattgtccaggctggtcttgaactcctggagctcaagtgatccacccacccctgcctcccaaagtgctaagattacag

SEQ ID NO: 3120 - DNA, 7390 bp, Homo sapiens
ttctttctttctttctttctttctttctttctttctttttctttctttctttctctctctttctttcttcttttctctttctctctgtcttttgtttgttcgttcatttttgagacagagtctcactctgttgcccaggctggagtgcagtggcatgatctcagttcactgtaacctccacttcccgggttcaggcgattctcctgcctcagcctcctaagtagctgggattacaggtgcccgccatcatgcccagctaatttttgtatttttactagagatggggtttcaccatgttggccaggctggacttgaactcctgacctgaagtgatccgcccgcctcagccttccaaagtgttgggattacagacgtgagccactttttctctttcttaaaacattttgcccaatgctaaattttactgcttggtttcaccatagtaatctgctctagaagaaaattaccacaggtgggattgtcaaggtgttccgggataatcatttctactttctttctttttttttttggagacaggttcttactttgtcacccaggctggagtgcagtggcgtgatctcagctcaatgcagcctcaacctcccaggctcaagctaccttcttacctcagccccccaagtcgctgggaccacaggtgcgcaccatcatgctgggctaatttttgtattttttgtagacacagggttttgccatgttgcccaggctggtcttgagctcctgagctcaagcgatctgcccgcttctgcctcccaaagtgctgggattacaggctgagtcaccatgcccagccctcatttctattttctacatgccttttttttttctttgctttcattgttcagcttcatgccatgatcttattctgaccatgatgaaattagtagaatagatcttcacttacgttctctgctcccagtgactaatgtagagacaagagtttttatattatttgaatttttgttatgaaaaaatgtaaacattaagtaatatagacataataacttaatgaactaccatgtgcccatcacccagcttcaactcactccccaatcaaggtgagtgtgtatctcccatgagtgagtaaactaccacgtgcccatcacccagcttcaacaagcatcgactcactctccaatcaaggtgaaatatcagacatcatgtgattttatcggttagcttccattataattgttgctcctttgaaagtaaactttgcttctcttcctacctgtaagtttctgtttgtctttttttttcaacagttatatatgatacacctaacttgtcattttattcaccctgctggagttcataagcctttgatagtatgtagtttgatattttctatcagttgtggaaaattcagatattatctcttctactctaggttatggggaaattgtgatttataaaaacaaattttaggccaggcacagtggctcacgcttgtaatcccagcactttgggaggccgaggtgggtgggtcacgaggtcaggaattcaagaccagcctgaccaacatgatgaaaccccgtctctactaaaaatacaaaaaaaaattgggctgggcgtggtggctcacgcctgtaatccgagcactttgggaggccgaggtgggcagatcacaaggtcaggagatcgagaccttcctggctaatatggtgaaaccccgtctctactaaaaaatacaaaaaaattagccgggtgtggtggtgggcacctgtagtcccagctactcgggaggctgaggcaggagaatggcatgaacccgggaggtggagcttgcagtgagctgagatcatgctactgcactccagcctgggacacagagtgagactccatcacaaaaaacaacaacaacaaaaaaccaaaaaaaaaaaatttttttgaggtaatagaccattaggagcaattgccttagcaaattcattgctctttatgtgcattttttgtttgctcttgctgaaagagctcattgctgatgtgtatatacaagttcactttgaagcaccgtatgtagatgagatgagagtaatgcaattggaagagactttctggtgtgctctgttgaaagttattcaaagtgaagtctggctcagtagggaaggatgttgcaattatgaagagcaccttctaagaatactgtatggaaattttcagcatatatgccataaatttaccatcattgatctgaattgaagtctttattaaaggcaataacagaacttcaatacaatgaaaaagaagaaataatatagaagtaatagtcacatagtagaggagaactaaaatataaaagacatctatattctttaggcttgctaggatctactgcgggaaacattactgctgttaatgtcttttattcacattccaaacaataattagtatcaaaatagtccttatgaagagctattattctttttctcactgttcctctttagaagatacatgcagggtagaaaaacgtaaatctgcttgtataagcagctctgactatttacaaagaagcaatattcttacaatttgattcattatgattttttgttctgggatcagcaaagcataatgactatgttcctgatctttagagttagactcttttagcttaaatcatagtttaagcttctaattcttactatttctgatacccagaaaaaaagtatcattctctctgggtcttggttttcttattaatacaacaatggcagtggtaatacttgtatcataagattaatgggaaaacacgtgagttaatgcccacaatcattgatgtagtaccaggaatatttgaagcaatcaacaaatattagctcttttttagttgccacttgtgaccagattccctttagtttctgtgtctatgtgatgttttcccccattgttagccaacatttgaaatttcttatatttgcatttacttctgtatgcaaatatatttaaaatctaaaatcattttaaggtcatattttaatcttttgagtttgattgagatgtctccaatttataaaatgttgagtttagcatgcttaagtgaacacaatatgttaaaaattctctattgataattatctgatgtgtaagaaaatgtaagaatgaataccacattatacacttccaattcttcattattggtcttgatgggactggagctcaatgcttcagaacaaatttccttgatgccaagattttattttcagtagatataaaatgtcagttttcttcaaaggaagaccaattaccttgacaaacaaaaagaacatgctagaagataactttgtcccctacagtcattcagtgaattataatttttgcattattgttttcaattgtcctccctaacttcaagagaagtcctgatatacgagagtttttctgacaagtacaccattgttaactaactttggtcttatatttacaaagtgaatatttacctaatacatatttacatatatttacaaaatacatctagatttaaacagcttatgtgtgatagataccaacattcccattgtaaaccaatacttacctttgttttgtgatattatgttgcaatgtgcagtctcaatggttgccttattcaggatctctttaagacaatgaactgaaattcacaatatttgcaaaagagaatactattatcattttcaaacatttgggatggcaaataaaacagatatccaaaatttcttacacacaatttatgcattcattgttttaattgaatgaagaacaaattgtaaattatcatttgcaatttatattaaggtatgaacttttacttatgaaatatatttatgagtcaatgactggtgatttaataagcacatgtttgtatatatgattgatgttattctaagcagttagttaacccaggcagtcaggaaaaaacaacctatgctatttttgcagcaaacaccttagacgtagtgtacgtctaatcagtcacaaagtactgtttatcacgacaatgcttcatatatctgtttccttcttcacagtaacatagctttttcctactcagattgtcattatttttatgctgagctattttaatattatacaaactctctctaattttcactttccagtattttccacaaattgcctccagagtaaacacccccaaagcataccttgaataatggtacactttcaatcatcttcagaggctatgaactatttatatgctaaaattctaattcattaacattaaaattatacaaaattgtaccatttacacaattgtactttttctaaccagttatatttttaactaccttcatatatgaaatctttaaactacatgattttgcattgatgtgttctataatatttttatgaatctggcactagagatggcacaatttgaatttttaaaataagaatgaatatccctaatttgaattaattttagtcttaatggtccgtggtcacgtataaaagatttgggagacttgacatgaattgtagaagaaatctgtctgcatttctgctttactgagatcagatctgatccctgtccaataacaaaatcttataatattttacccacaaagtttcagtttagtcctgtacaaactcatgtccccatgattttaagttatctgaaccatgttattccagcttgagtaccagatgcattgctagactcatggaaataaatgtcataagtattgctgagtcgttccctcgccagacccagagtattgaagttgagtatttttcttatgatgatttaatggaaaaagaagaaaatattgtcactagttttccatttgctcaaatttgcaattttccattttgttcccaaattgggttattccgtattttaaatatattctcataggatggatgtggctagtcatggacatgatcttagttgaacgtgaaacaaccacttccctatctttttcaaaatgaactaatgagaaaccaaataatcaagctaagtcttaagtcatcactgcataagcaagccatgcatgaattatttttctacccaagaatattcttgtttatttagcatttcctcctctatttctgtcatatatttgatgatttctggttcatttatgctaaaccattattatccactgaaggtttcccttctaattggtaattcacagataggattagcttatttgatgcagggaactacttctaatggttcaactgcttctctcctcccttttggttactaggacaaagtttgataatagtaaaacagagggaaaagcttctgtttatcaggatattttaccaatttatattttatttcatttaaaagtaagtattcactacacttaaactatgctagtgttctcaaacattaccaaggtgtaattatcaaagtagtatgtccagttgctacaaaacacagcttcgctctagcaataaaatagtcttctatatggagtggtaattcattttatcgaattgtattattttccagctttatttaagtatgactgacaacaattgtgtatatttagggtgtacaatgtggtattttggtgtaagtagacctgcataataattcccacaagcaacttaatatgtccatcgtctcacatagttaccttctgtgtgtgtgtgtgtgtgtgtagtgagaacacttaagatctactctcttagctaatttcaagagtccaatacattattgttaaccataattaccatggtgaacattaaatctctagattttattcgtcttttaactgaaagtttgtatcctttgaccgatatctctccatttcttctactgcctagactctggaaaccaccattctactctctgtttctctaagttcaacttaaaaaaaaagattccacatataagtgatatcatgcaatactttctgtgtctggcttatttcactaagcataacgtcttccaagttcatccatgttttcaaaatggcaagatttcctttttttaaggctgaataataccctctctctatatatgtacacatacatgcaaacacacacacacacatatttacttatattttacctgttatttttagcaccataatctacctagaaattattttttacttttaaaaaaattttttcaaaatctattgttaaatatctgtcattttgaggaacttattttatcatattatatatagacatacacatatatgcacacattatttgtacacagagacatatgactttattattagactccttccttttgttttgatatatttacttcataaacttatcatgtgaaattactcacagctttatttctagaaaggctatatccctacctcttttgttaatatatttcaacatatatatctgggctgaaacagcacaacatcattacagaggagtatccattagaatcttaggccatacggtggggcgcgatggctcacgcctgtaatcccagcactttgggaggccgatgcgggtggatcacctgaagtcaggagttcgagaccagtctggccaaaatggtgaaaccctgtatctattaaaaatacaaaaattagccaggcatggtggcacacacctgtaagcccagctactcgggaggctgaggcaggagaatcacttgaactcagaaggcagaggttgcaatgagccaagatcatgccactgcactgtagcctgggtgacagagtgagaatccctctcaaaaaaaagaaaaagattcttaggcctaggccataccgctacatctgatatttacgaccttgtgtctaacatgtccctgtacagcttcttcatttatggagcataatttcctttttcaattattttctcctttaaacaagtaacacatgaatttactttacaaaagaaactgaatatatactgtaaaaagtgaagaacacctcccttcatggtccctctgacactatttatatcagcaaaaaagatcactgtaaaatgctgtgtatatatattttttgaccgttttcaattttttttgcatgcttatgaataaatttacttctttcttgtttccatagcaacagattattgattgcttccatactaacccttgcttccacattaatagattattgcatgtctttctgacttaattaggtaaatttatacatgtgtatgtgtttgtatgtgtacatacatacttgtttcttatttttaaagtataagtaaatgtaaaatataagtaaaatataacttgacagtttcacacatcaaatttgtatgagagggtccattctccacacattgacctatgaggaaaagtattatttttgtcaattcaatgggcaaaggatgtattttaaaatacattctcatttccatgattacctttgaagttggacatttttcctacttatgtatccttggctcatcttttaaaaaaattctt

SEQ ID NO: 3121 - DNA, 13818 bp, Homo sapiens
atttaaacccagaactgtctactgccaaagcttttgcgctctccctcgtgccacgttgcttctcattttgggcttggtctccacttcccagtccttgaaggagttctccaggtctgccccattagcactgcatctcagaaggaagctgcagctgcgccgccaatctcccggtggtgcttaataaacattatgaagtgcatgaacaaatgaatagcccctgatggacagacatgcttgagaaacactatttttcacattcctatctacactcaagattttacctatgatagcaggctgaagattcccaggatcttacatcctagcaggtaagacaaacaattaaccaacagaatgattaaggtcacagacatgctaaggaagaattgaagccagatgtgataagcaaaataacacctccatccctaaagatgtccatgtcttcatacctagaacctctgaatatgtcaggttatgcagcaaaggagaaataaggttgaagctggaattaaggttgctaatcagctgaccctaagatagagagattattctgggttggctgggtgggcccatgatagtcacaagtgtgcttaaaagtgaaggaaggaggcagaagaggagagtccaaggacaaagtgactacagaggaatggtcggagatacaattttgctggcttagaaggcggaggaaggggccatgagccaaggatacaggcaacctctagaagctgggaagggcaaggaaatgaaatgtcctttatgaaaagtaatgcagccctgtaacaccttgattttagcccactgagacatatgttggatttctaacatacagaactgaagacagtaaatgtatgtgtgtgtgtgtgcgtgcatgcgtgtgtttcctgagtcagggtcttgctctgtcacccaggctggaatgcattggcacgatctggctcattgaagcctcaaacttctgggctccagagatcctcctgcctcagctactctggctattttttttttttaatttgtgttttttagaaatggagtctctctatgttgcccaggttgatgttgaactcctggccttaaacgaagctcccacctcagcctcccatgttgctgggattacaggcatgagccatcacatccagctaagtctgcattgttttcagccaccatgtgagtatcactttgttacaggagtaatagaaaaccaatgcactgagtgatgatattgattgtaagcagggaaggtccctttagaggtctcacaaaatgtaacagtgtaatgaaatgcgaaaaagcaagaactaaccttaaaagagctgagagaagattccagaagaagaaagagctggtattgagttccagagggaggacactccttggcaaaggagacccaagtggctgagctggtggagcaagaaacagagagagaaaagatgagatggagctggagaggttggcagaggtcctctgcaggactgggaggtcatggcaggaggactggagtttattttaagagcaatagatggctatagaatagagcagaagggtgataggttgtttttcactttcttaatgatatccttagaggcacacaatttttaattttgataaagtaaaacttaaaaatcttatccttcatcacttgcagttttagtgtcatatctaagaaatcattgccaaaccctagaccacaccgttttactctggcatttccttctatgagttcaacagttttagcccttacatttaggtctatgatctaccttgagttaatgtttgtgtatggcatgaggcagggatccaatttcattcttttgcatgtggatatgcagtcgtcccagcaccatttgttgaagggataagtaacattttattgcaataaagacagactcagtaataatgctatgctgagccatgttgatgcccaaggcaaaagaaaaaaatcagtaacatagtgttttgtaaatattaaagatacaaattctttctaatttggtcttgaagtctctccctggagagtggctataaactctagccctgccctgacgacagggctccagggaaggcagtttctggatgtttacagcatgcctttcaagggatacatctttatcctggtagactgcctaatgcctaagtgtccggccatggccaggtgttccccatacagaaaacttgcttttattcacagatgtccctgtggctcttgtctaagctgtgtttagtttattcctaccaagatagccactccataggagagccctgaccaggaaagaagttaggctcatgtttgtctgtcaggggagacacaggaggaggcagcacaacaccgagcatgaaataacagacatatttattacttacagattccacagtgcagggggcagtatgcctcccagggtcactggaaagggggaagccactgaggacacgtgcattcagccagcaggtggggagcaagagagagagaaggggacctgtaagccaaattctttattgggtcctgggagttactcaagcaggtttcctgtggggaggtctaactggtggtacaagcaggcattagtttcatgggggtcacgctgtgactaagaggtggccactgtggcacacctgcacagtccatgtggggtgtggaggtcagtggggctaattaggtcagttgtatctggctgtctcatggagaggtaactatcacgagttatataagccagagagctgaactgaccaccttaaggaactaggaggagttgtaaaactggatactgcaccaagggtgactaagcctgcttctggtatgagaaagttaaagttatattcaaaatggatactgaagcaacatgaaattataagaattcactcaatactatttatcttaaaattttatttttttttcactgtgggtttttgcattaattttgtttaaaatattgcatttaatattacttatcctagttactgagaccttgaagcccttttacattttgtgcctaaaataggccttattcacctcactctagttaatgtcctacaaagtccctagctcagcttaccatgccttccacaccctaaaccctgcctgcccctccatctgcctctcaccccccattcctcaactgttatcactaataatacagattagttcatgtttccttgcacacatcatgctatgtcaagtgtctgtcattttgatcttgctcaccacttgacttggaatcacttatctttaatatcttgctctttcccatcctacaagatcaggtgttaactcctccagaaagctttccttgcgcctccgggtgggttggcgctcctcacccaggctcccacagtgccctcctcacccattgtgctcccataattattatagaataataacataataacatagcatgtattaccctgtaaaataattatttattatttgtcttctctccttctggactgcagcactttgtcccttatgtcaaactgtatcttacccacttgaacattctcatgtcctagcacagtgcctagaatatgacagataagtaatagatatttgtttaacagttaatctagctagaagtacagcaaggagaagccaatccaatctgcctaaagtgaacagagaaggttcctcatggaatctccctggtaggaggacacaagttaagcatctggcacagaacgcttccctgctaaaaaggtgagacatcccagagaacagaggctgtgcctgaggcaagagctccttgtctggactccgaggatggaagcaaagacttacaagacctcattagagagtcagccccatagacagaaggataatttagaaatttaataactggatctggcctacaagtgaagcagagaagtggctacttccaaggagtgaaacagtgagcaaaattaagggaaaattcccactgagctcacttcatttattcattcattcattcactagtcatttcataaacatttatggagcatcttttgggggtactgggataggccctggaatacagggatcaaagatcatctccttacccaaagaaatccatggccaagtcaactgctgcaaacctactatgtgtgggatgggaaaccaaaaaatacaggtattaacaacaaagtctagccttcagtgtttttactggattattctatttgcctatccaaatccactctctatctttgtccaccctgctattccctggggaagctgaacctgaaccacactcttgggctcccttgaccactgactaccaactgcacatggccagtgttgtgcatcagcaggagattggaaggagagaagtgagtgagggtgtggcatttattactattgccgtggggtttccatgggccagttctgttgaaagccaggaatcctatgtttcttccgcatagcccccgcagtcttctggctctctttcccctctctccactctttcaggcctacaatagcacctagatttcatagtcctctggcatttgactattcttcgtggtttccctaagccctgctcccagctttgtaagtagtcctttattaaattcatttcacattatccaagtgtaagtgtgccatctgtttcttgctgggaccttgactgacacaacaagctcctaagggagatgtgacaagaacatcaataaacgggggatggaaggaggaatccccttggacatgtgaatgaatatatatggccacccactgggaaaggaggccatgagaaaaagtcaaagccaaacacgttgggattatttgcctttatgcccaggaagctggaacagagcagggagctggtcgaaggtacccgagaatccatccctgaaggatagcagatttggagggtaaggaaagatttctttctacctgagaagtgcctaggagacagtgactctgagttttcttggggtagacagcaatgaaggcttaataagcagaccccccagactggtctcctctccccttgccactgtgggaccttgaggcaaagggaggagcagactgatgcacctcgagtgctatagagaaagggaaacaagactgtttcctgagttgcagaatatgtcaaaaaataagaggacaaaaccacactctgtcaagtcaccttaaagacacgaaataggttctaggcctataaaagtgcctgtggcttagcatagctagaggttatctagatgttttcagtctgagaactttcacctgaggaagaaggacacatcagactcttctaacagcattcgagtcacactactcacatccctcttttcagttccatcctcctcaaaactccttagaggtattatttggttcctcatgtggttttcttacatggaagaagaaccatatgtatgctgatcaggtttaaggtacctaacaagtagaattcatgctgaaaatcaatactttcggcatctgcagtctcctaaaagcattgttagtgagagtcagcctccccaagtccaggaaactcaaacactttgaaaatctaaacccacaaagccaaggtcaaaatcctggcttgggtgaagtcatgaatatcagtgctgcctggaggctccttggaagcccaccatccaccagcctgggacacacacagacacactggtactttgatgagccctgctgcccactaaagtgctgatttgttagaacagccattgtaccaggtctctctcatccctttcttgaacaatggattgctcttccaaacttttttctttttttttctttgacttttaattttaattttaattctttagttgacacagatcttatatatatttattgtgtacagcatgttgtttgaaataagcaggctttctgaaatggctaaatagtgctaattaacatatgcattacttcacatacttatcatttttgggggtgagataccttgatctgttttcaatttcatagcctggcattggctcattgttctatttgactgattctgcctgtcactgtatctaccacctctgtcagattagagtaatccacaaatttggtaagcaggcgtgacctaagtgactgataaaaatgttaaatatacaacctgaggattcttcaatcccatcctggcttctctccttttaaaactttggtctgtccttttcagaactacatgcagcatgacaagtgtggtctagcctgtgcatggcaaagcatgcctctcacctcgttgaaattctctgctcctgcaggctgagatcaaaataactcccttacacattatggctgatattactgaagtgcttctgtcatttttatcctgaagatactaagtcacatcagtgcatcttgttagttttcttttggactcgggtgtaacatgttctgttcctgttcagtttcagttttgcctcattatgcttagaccattgctgcagcctgttaagatctattaggatcctgtgcagaccagactcaacctctcatcactcgacttgtgcctaactctctagtaccatcccatccccacttctgtctctacactttatttctagcaatagtaattgcttcagggcctccccaatgtcttctagactgtgtgtaggatacaatctctcccacacagaaaaagtctcagactaacacaaagatccacatctcaaactccgacccattccactccatgcaacagaaggtaaaaggatatgggagatctctgagtcatgtgaccaggaggctggggtctagtcctgtcttcacccttaaaaggctcttgtctgtcctgtgagcaggcatagggtacagcagtctgaggatacaccagggtctttctgcccctctctagctggagcagaggctgctcttgcttcccaatatccattctctcattcttttctgctcgtaagaacagaccccagtatttagaacagcacatataaacccctgaaatgatggcattgccagctgctttatagccaggagtggtcaagagataaagttttggccaatgaagtgggaaaagtcatgtgtgactgactttcaggagggtcttaaaggggagggaataaatgatctttgtcctcatccacttgcgcctgctgtctgcctggaatgtgaatgtgatgacaggctttccagcagacatcgtaggaccatgcagtaaacttgaggttagaaactggtctgatgattctggaggagaaagattgaagcatggtctcggaaacaccatgccaagcctagactgcctttacgccaacttcttttatgggagaagggaagtaagcttttacacatttaacacacctttcagaagccactttcttctatatttatgatgttatctctagctgcttaactctggaaaagcctcctattctctaaccctatttatccaactgcaaaatgaaactaacaatataacaggaaggggaaaaagatcatatgtcaagcattgacaagacactaggaatatgaaggcaaaaagataaaggcaattcagtctgcagattttatgtgatgatcacctctcattgctcactcactatttctttctttctttcaacaagtatttataaagcctcaacagagatgacagttctgaagggactagggttgccatatttagtaagtaaaaatacagggacaacaaatctttttttttttagcataagtatgccctgtgcaatatttttttattaaaaagataattgttgtttatctgaaattcaagtttaactggttgtcctgtattttatctaatgaccctacctggggctaccatggtgaataacactgaaaaaagcccatcctgcaaggagctgtcttccagtggaggggatggtgcacaaaccatgaagctcaatatcagaactgaatgtagggataagtggcatgaaggaaataaaaccactacagtgtgacaggaaggtgactcttcaagattgtcagggaagtcccgtgaggatgtaacatttccccagatgcctggacattgaaatggaactagccaagccaggggaggaccagtccagcctcaggggccaacgagagcaaaggccctcatgtgggaacatgtttgggatgttctagaatcccaaggccagtggggttaatgttaagtggagagaggtgtgctggagcccagtcatgtaaggcccataggtgatttttttttaaaagaggccatggattctattttaagagtaagtagcagccatcagagggttaagaagggaagaatatcgtccaatttatttattattgtttattttttaaagaaggtcttgattgcttggtggggatgagacagggttggagaagtaaaggcagctgcaggagaatgagtaaggggcttttcaacagcacagctgaactgacagaggcttcagctggagagctgcagaagacctggtgagaaggatcccacgggctatgtgtttgggagtagggcagacaggaccagtgaagagattcactgtggaggctgcaggagagaagcgaatcaaatatgatgtgcagggctgggtcctgagtaactgagtaaaaagttctcatttactgagatggagacactattcctagggcaggtttgtggacagcatggggcagaatattaaggagcttgtcttggccagattccttagattagatagtcaaatggagatgttaacaattaaaagttgcttttattatccctaatttacagaagaggaaactgaggtctcgcaggttagaaaagcaggactcataacaaaacctgtccagacccagcttgcttccccagaccacactattataaacctccctgctgcagacgcgaaacaagcaccaaatgagatcatagacttttaaattataatgattattaacgtgggacagtgtctggagacaggcagggcatggaacctacaggatctagggagcaggtaaaatgtgctcggctctgctttggagctgagtcctccgcacgccagggtcagttacatttccacagacaagctgttccacagccagacttcacgccatcccctctgaatcatttaaattgcctttgctaaataatttacctccatgtagacaaaagggttccacaggctccccaaacattgtgggactggtgcataatttacaaagcattgcttagccgccccgtgcagggagaacaacagggcttggacacctgccagagccaaggagggcaccaactggaaaggaggcaaaacacagctccatcaaacagaggcaaaggcacctactgacacctggattctcaaggccaaaagcaagacaggaaaatgtgagggtcaaactgcctctgggcacaggctgaagccagtgagggaggggcacgtagctagcatgcgtgctggaagtctgaggaaaatatcatcaatgctacactcttcctgattaccaatatcctgagacctaattaattatgtcctttaaaaaagcagcattgcctctggtaagaagcatgtttagcaaatacctgagcattttaacacaggcaagaacgatgtggaattcagacaggaagggcaattttctgtgcctggaatgccttcctccacatcccttatgcacttgacaaattcctgctcctttttccagagctgtcctcaagggttacctcctccaggaagcctacctcactcccagaggcagaccaaggcttccttctcatcgtgaactatgttttatctctcatttcattgtataataaatgttgttttcctcccctggactcaggtccttggtaacagagtttctttaaatctgtagtcacagtacatgattcagtggtagcacattctgtattcattgtagaatgaaggatgaaacaaacaagacatgcaccataacttacaagatattttccccagcattgcatgtagtattgttgctttaagcataaaaattcatatcccaagagaatggcaaagtgtgtataaaataagcaaacataccagaagttgctcagcatcttcaagagtcgttctgccccttgctccatgtcttagcccattttctgttgctgtaacagaatatcacagattaggtaacttataaagaaaggaattttattcatctcacagttctggaggctgggagttccaagagcatgatgctggcatctggtgagagccttcttgctgtgtcataacatggcagagggtatcacatggcgagagggcaagagcacacatgccagctcaggtctctctccctctcttatgaagctgttgttctcatagtggaggctccaccctgacaactttatctaatcctaattaccttgcaaagaccccatctccaactgacatacggatttgggaattgagtttccaacacaagaaatttgggaaacatatttaaactatagtgctccacttggactaatacttcccatttctaaccacctgtcagcttcagctctttgagtttggcatctaattcattttacaatgcctgactcttaataggatgattgggttcttgaatcagacagatatattttttttggaagtttccagccatgccacttagaagctgtgtggcctcagtttagtaagttaacctctctgatcttcagcttccttacttataaaacaggcacagtagaagtatagaggtattaataatgcctacctcattgtaatgttgtgaatattaaatgagatcagtgtatataaatatcttagtgcagtgcctagaacttagtgatcattgaatgaatgttagctattactactgttttcactttactacaagatgtattgtccattctgtcactgcacctgctttctatgttctctaccagtacacacaccttcagttcagccctggacttgctgccatgtatccaataccccatgatcagacccagaacacatttggcaatcataggttctcttcttgtgattataacaaatttcctcttcctggatgcttctcaagatcaagagtaaaaatctgagttatcttaagctatgtttgggttgtcagtctgtgctgctttgaatataactcccccaaaatactgcctcatataaagccccagcttatattagggttacttgtgtttgagcctaaagatacaatggcagttagaatttaaatggcatttactatgtgcttggtactttttaaaagtcatttatatttagtacttaaaaccgaagaggtaccagtatatcttcattttgcttatgagaaattgaggcacagagaggtatcgtatgagggtgggagtgtgtcacactctgctcaggagggcttgctagtcagagctgtaaactaagtttacatccttgggagaagaaaaactttgtccattctaaagggtctgacttttcccagttttagacatcaaggaagaggcaggttctgttatagaaaacccagccttgtaaggcaaggattagatgggcaggaccaaggaatggtcatcattctctgagcccactctctttagttaagattttaatgcatctgaacatattgaaaaagaaggtggcagaaaactggcccttgactcaagatagcttttagacttagggcagggtagggagataggttgtaggaaaattgagactactgttaggtagcaggtatcccatacaataaaatgtcaagtggtaccctctagagttaattcgcttctgttatctgggagccctgttaatcattctttcatgccttggttgtaccatggggaataaaggagtggatttaggttcaccttggacacttgtgtgaaaataagatctgcagtctctggaaccagctttgttggatgcaaagagaaagtgtgtctcagggataagaaagaactccctgctaaccatggggagcttctccatctattgctagccaaggtggatgaagatttgatttcattaaatcacccggcacatttctttacctgcccataggtgagtgagtccataggagagtgaaaatggaggccatttccagccaaacctggaggcttccgtgggtcagacaactaggccccaagagaagaaaaataaataagttaaactcccttcatcgggaaaataaacatcaaatggcatgtgatagtgtgcactgcataagtgaataaaggaggtttaattctttaattattgcctctagtttccccatggtaacaaagggcaagttgatgaagagagataatcagggcataaaatattgtgtctccttggtttatttcacttaataaaataataaaaatatttctccttaagttcccagtcttgcttaaaaaaatgagacagtatttttatctaaactcatttcaaaacagatccataaagatttactgagtacctactatgacactgggttcaatatgatggtctctgctcagaaagcacaattctgacttccccttgacagtccccacaactcacattcacacacttttaagaaatttcaggccagacatggtggctcacacctgtaatcccagcactttgagaggccgaggtgggcagatcacctgaggtcaggagttcgagaccagcctggccagcatggtgaaactctgtctctactaaaaatacaaaaattagatggccatcgtggtgcatgcctgtaatcccagctattcaggaggatggggcaggagaattgcttgaacccaggaggcagaggttgcagtgagctgagatcatgccactgcacttcagcctttcagtctgggtgacagagcgagactcagtctcaaaaaaaaaaaaaaaaaaaaaaaaaagggaaagaaattttagttatctagtggactcttagaagatattttcgtttacaacattcaccatcaagagtctatgacttcactaatattcacctatattcctttgaaagattgtgtctagcaatcttttgtgttcatgttaagcaaactatatttattaagaaatactttgtttccccatttttgtatttagaatttccaataggaatttctttcaagaaataacccatgtgcttttactgagttaatagacttccagccaaagtgtctccgttcactcaataatcatgaatacagtaaatacctgctatgacccaggcattgtttgccatacttgggatacaacagtgaacaaaattctaggtcctcgtgtagcattaattctagtttaaacataaagtcaaaacaaaatttaccaagaaaaagcaaattacattgtatatcatgtcatgattagtgctactggaaaatgcaatgcaaggtaagagagggagtcatgagatgtcaggggatagtggtgatgaatgtggggaagggaggctgtaatttaagagtactgagcataggtgtattagtccattttcacactgctgataaagatgtacccgagactgggaagaaaaagaggtttaattggacttacagttccacatggctggggaggcctcagaatcatagcaggaggtgaaagccacttcttacatggtggtggcaagagaaaatgaggaagatacaaaagcggaaacccctgataaaaccatcagatctcatgagacttattcactaccatgagaacagtatgggggaaaccacccccatgcttcaaattctctcccactgggtccctcccacaacacatgggaattaagggagtacaaatcaagatgagattttggtggcaacacagagccaaaccatataattctgcccctggcccctccaaatctcatgtcctcacatttcaaaaccaattatgccttcccaacagtccctcaaagtcttaactcatttcagcattaatccaaaagttcatagtccaaagtctcatctgagacaaggcaagtcccttccacctatgagcctgtaaaatcaaaagcaagctagttacttccta

SEQ ID NO: 3122 - DNA, 945 bp, Homo sapiens
gcctattgggctgtctgtgcccctggctggagcagaaactgaggaaggaagatcctacggctcatcaagtaaaacggtcttttggggaagaagcattcttagaaatgctgcaccaagagttggaattgagaattcagaaaacatgatagagaaggaacaggaagaaaccatttggacatccaaaaataaaaggccagaatctcactttgttgcccaggctggtggtctctaactcctggacttaagcaatcctcccgcctcagcctcccaaagtgctgggatcacaggtatgagccaccatgcccagctatgatctcctatgctgtttttgtcatcttgttatataaattttgactgttcaatttttatatttgctcattttcgagtcccttaaaaaattttaaagggggaaatatactatctgtaaataaatatttaatggatatactatctgtaaataaatatttaatggaaaatttgaagacagcaattcataatggaaagaaaagggttttggctataatacaggtctgagtttatattcttatccctctgtaggctttgtgagtttgggcatattgctaatcctgattaatacttaatattctcttttggaaaatggaggtaagtggtcagataaacacataaacttactgtgtggattaaagattgttttctctccctatgaacaaggcccattattgtagcatggaaaagaaaagactgaagggaaatacaaatgttgtcatgaaatacaggaagggctatcatgtttcaaagggccagcagagctaggactagtagatcaatgtaataaaaggttggattttgattccaaaagaaaaagcaattctctcactattagatcattctaacaatgagatgagattcttgtcactgcaagtgatgagcaccatctggaagagcagtcttgaggtatctgac

SEQ ID NO: 3123 - DNA, 1515 bp, Homo sapiens
acctgaggtcaggagttcgagaccagcctggccaacatagtgaaaccctgtctctactaaaaatacaaaaattagccaggcatggtggtgcccatctatagtcccagctactcaggaggctgaggcaggagaattgcttgaacccaggaggcggaggttgcaatgtgccgagatcataccactgtactccagcctgggcgacagagggaaactccatctcaaaagaaaaaaataaataaataaaataaaacaatgtataaaattaccttcacgctatgtgtataaggcgtatataaaatataaatgcattccatgtttacacgtagactccatccccaagatttgcattatacatatgcaaatattccaaaatccaaaaaaatccaaaatctaaaacacttctgatcccaagcattttgaataagggaaacccaacctttatctccaatgtacagacaagaaaaaatggagattaagtcccttgccagtaactggcagagccaggacttgtaggtagatctgtctgcctccaggtgccaggccccacagccattaccctattccctggagggaaatgccaaaagtgtagagaaaatacagatggtgcagaaacatttgagaaatgtacagccttgccagaaattaaaggaatgcaaatccaagcaaccgtggagcatttaccacctatcaaatttgcgaaggtttttgtgcttttgctatttaatttgctttacatccaagtaatacatgttcatggtttaaaagagtcaagttgtattacagaaatacaagctgaaaaccagcccactctgccctagcccatcaaacacacacacaccacacacacacacacacgcacacacgcactcatgcagtgggaggaggggaaggcccctgagccaggcctgtctccctgccatggccttgacctactgtgcttccggacctccccacttcctctgggctctccagggactccgggaatactggcctgatatttctgtgatcttcccagtgcagcaaagcaaggggccgagtggcctattgtggagatgggaatggggaatcagagggattatgcagcaagacaccaaaacttgacacagtcacctataatctcatggtgggaagttttctcaagggaaaaatcaacactggccacataatttgtataaaactacatgtggaaatgctatattttcattgcagtaataatataaagagttttgtgttttagggtttttttttttttttttcgagacagggtcttgctctgtcacccaggctggagtgcagtggcatgaacatggcccactgcagcctcaacctcctctgctcaagtgatcctcccacctcagcctcccaaatgttgggattacaggggtaagccagtgcacctggccataaagggattttttttttgaaacagggtttccctctgttgcccgagctggagtgcagtagcacaagcatggctcactgcagcctccaactcttggactcaagtgatcctcc

SEQ ID NO: 3124 - DNA, 4565 bp, Homo sapiens
ccgaaaaccacaaaagaaaattggaagaggaaagaaaaagtcctcaagaaaaatagcccagatttctcatgatctcactcatccttggtcagcaggtggctctcctccacatggtgattcagggactcagattctctccatcttgtgtccccaccaatgtcctagggctgcgagtactctgcccccaactggtggaagggaggagatggtggcgagaaggtgcatctacttctgaagtgccttgggttggagtgaaacacctcacgtcctctcacatctcattagcaagaactaaccaaatagccctgctcagatgcaaagggagctggaaaaggtagcccgcaaggagtctacactatgaagggggaatatatggaattgtggtgtttgcctgctatttctgctactgtctgataagtactttactgcagggggtgcacttgggataccacccaggcgggtaagagaggcacctaacctggatttggtgcggggagtcatcacacattgttccttatttcccctcttctcctcctgagcttgatttcacctctccagcctgcctcttccccgtgtgtatctctcacaccattgcacctgctctttcctgtccctggaatttttctcccacttcaccttgcccttcctgtggctagtgcagtattccatcagggacaagcgtggaaagcattcccccaagaagcctttcctggacccacaaattcagcttgtgttctggtcttttatggaggcaaagaaaggcgatttttatttattggggtttgaaagctgatacggtttggctctgtgtccccacccaaatctcatctcaaatcgtaatccctatgtgtccagggaggtacctgggggcaggtgattggatcatgggggcggtttcccccatgctgttcttgtgatagtgagggagttctcatgagatccgatggtttaaaagtgtttggaagttccccctcccccccctccctttcctgctgccttgtgaaaaggttcctgcttgctcttcaccttctgccatgattgtaagtttcctgaggccttcccagccacgcggaactgtgaactaattaaagctgttctctttataaattgcccagtctcaggtagttctttgtatcagtgtgaaaaaagactaatccaagagcccatgaaaaggcatgtctgctaatcagatggaagttttacacacataaacttcagcctctagagaaaagagaggcaggggagccataaggtgatagggaagtgaggacgggacctcattcattcacacgttcaattttccaatagcttagaggggagaactccagccctttggaggtggagaggcagcgtgggctcccagatcacatcagttcaggaacctacatttctacaagtgggttttatgagttgtttctgagggtttatttctagggaataaatggtacaaattttcaaatgccagttgaggagtgggacatcgagatcgaggcagggcccttcctagggaaacatcctctttgaccagggaggagaaggacatggttatccagccagcctcagtcttggagcagaaggtggagggaaagtagactcctctagggtcagaacaatcatggaatgcatcttccagttccaacagccccaggatcttgtaaaggagcatggggttttaatttttaaatacgagaaatgagcatatttctcctgcagccgagcttatctccttattaaaaaaatattttcttactaattatttctgatgatctcaagggaaagcgccttttgcgattattttgacaagttcatacatgcaaggggcttgctgatcctgcatttacaaggcgatggttgcttctactgtttaggttaccattagagttccctaaaaatagaaccatgagctgggtgctcagaaacaaacttggcagaatggtttaggaaggggactgagctaaccccattgggacagaatacagtcggtttctcttattctacgctccagtctgaaagcatggttttctgaggccacgcgctgggcctgtataccataagagagtaatttcactgtgagcgtaatgataaatgcagaaactgaaggcaaaatatccaagatatggggtccgtctttaagatcagatagaccagttcttgattagcagccattcaggaaccctcagactctcagcctgtgggtggtcctcagtgtttcttgtgacttcttagcccaagcccaaacattcactcattcaccaaatattgatagagtacctgctgtgtgccagccaggcgtgggccgctgcacttggcccaaactgccttttttcattgtgttggtgaatgcgtgcagagatggaggtctgctttccaatcttacaggaatttgcttttcggtgaaaaggaaggaattgatgaacacaaacagccttgtggcccctgttcagagaaagccaatggaagttggtggaagaccaaaccactcctttctgttccttagaaccacggggctgcccaccaccgggcaagtgtctggcttgtgagagtgttctgacttttctgcagagaacttcaggtctcattgtcccatagagcaactttgaccattgcccaaataaatccttggatctggctggttaacagcagctctgttgctaataaatcctttgaaatcttttgccttgtgtttttcatgacatatttgcatgtcaggatcatttgggttttggagttgcggtctcctgctgttcctaacgtcataaacggatagtaataacccaggaggggattatgttttggggttgcaagtagatgagctttaaaaacattaatcttatttgtgggcaaatatggctaatgatagactagggaaaacaaaataattcaaaatctgcaatgaatgcttggttatttccaaagggcctgctttttaatgaagtgcagtaaataatgaagaataagaggggaaaaaatgtagaaacagcatcccaggagtttcttggtggtgttgtttttgttgttttaataaaaattaaaatagacaaaccaaggcaagggagtagcattgacctccactcccaagtggggctggggctggacctcagggctggatcctatctgtgggtcactggtaaaagcaaacctccattactggggttctctgcgatgggtgactttgccccaggggacactggcaatgtctggagacatttttggtgtccctgggggtgctaaacatctaacagtgcacaggacgtcctctcttaacaaataattatccaggccatgcgtgttgctttatgcctgtaatcccacctgtctgggagacccaggagggaggaacacttgaggccaggaccagcctgggcagcatagcaagaccacctctacaaaaaaattttaaaaattaggcaggggtagttgcatgcatctgtagtcccagccacttgggaggctgaggcaggaggatcactggagcccaggagtttgaggctgcagtgagctatgattgtgcctctacgctccagcctgggtgacagagtgagaccctgtctcaaaaaaaaaaaaaaaaaaaaaataagatctatccagcccctaatgtcaatggtagggagaaactctgcttcctggctgccccctgtcctggcctcatctcccgtgtggattggctcttgccacactttcctgggagttatttcatctcaaagtgaagcctgcaaggggccttaacattatctaatactaagttttactgataggacttgcaggacttcacatagattgaatggctttccaaagttcacagtaacagaggtgggatcaatcaacaggaaaaattattaggagcatttgtaaaagaagaggctttacaggctttttacattctactcttggatgcttactttgctgatgcttacaagaactgtttgttgagtgtctgttaccatctatctgctctgctaccatctatcacccgaagaaacatgaaggctgtcttaaatgggccgtaaaataataataatagtaataataatgttgagaacatttgctgagtgtttactctgagccaggactatactaaaccttttaataaatcctggatctcattaaatcctctccacgaccctgcaagcaggcactattaatgttcccattttacaggtgataaaactgaaacgcaaggagcttaggaagcagcgggtgaggaatctgagccttgctcttctggattgcagagcgggcactcctaactgctaagctcaccccttttcctccctgatgcttagcaattcagttgttcctgtagttaggaggcattgttttcagggtgtttgaacctaaactcaaggagaagaaatgtacatacatccttctggctcacactgctcaggccatcagtggggtttttgccagtgttttggttgctgctggttttggatttttcagtcatatcaggactttagtttgacttccacaaatacttttggtgaagatttactgtgcccaggaggtagctaaacattgggggttcagcactgagcaaaatacttgtcttagtttgcgtttat

SEQ ID NO: 3125 - DNA, 4613 bp, Homo sapiens
gatgcccccgcccccgccgcgtcagggttgctccctgcgcttccgagtggcgactgcagcgggtccggtgcaggtgaggggcgcgcgcctgcccagctttgcagcccccgaacgcggcctcgcacagatacccagacaaatggattctaaaatttgaatagaagagcaaagaaaataggaaccaatttgaaggactacaaggtggactgcttgctcagctcagtatcaacacttatggagtcattgcagttttcagtagaggtgtacttctgagaagtggcttcttgggtcttcatgcagccatggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgacagtcaaaagtttgaaatgactcaaaaatttaattgggctcatgtaatacatattcaaaaacagacttgaattctacaatatggccagcaggagttgatgcatttctggaggaggaagtgactgagttgcgggaaggtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaagggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtgttaaatttgaacctagtggtaaaacagggtgatttcaagagacacgtaagtgggaccttctattcttttgaaacctctcattttgtcgttttgaaatggctcattgcaattgtcccttgatagctagcagatgactgatgtttttgcaattattttagggggggtgcaacattttatggagtcttaaaatatctgttttttaatacaatgctcttctttgaggaaccggaaaggaaatttgttaaggaattatttcttttgtgttattaagatgatcaggcatacatttgcagcattttggtttcttctttcttcttttacttttagctaccaagttttccattgggagttcttttgggaagatacaaattttaatgttctctagtctagtacatgcaaatttctagttgatacagtacctatcaaagatgtctgtaacatcagtgaagcattagactttgtcacaatatgattgggactcttcttttgagcaaaaatgtggatacaaatcataatcttattttatttgggattatattttataattctaaggctatattagaacaaaagcatctttgatgatgacttatttgaaaagtatttttaaagccaattgaagtacctgctttttaagatgtgttataatttagcatgtttataatccaatataaaaatataaagcctatttataattaggtctccagtaatgcttcttgaattgaggcagtggggtgggtgaggagaatatttttcttttgacatcacttatgcttctagttgtagctttttatgatgaaaaccgtgattgatttactagtaaactcagagaagatagcttaaagcagtaggaaaactgtagtgtgacttttcagttaccttttcaaagattcaactaaatatctgctatttttaacttgagttccttttattacttctttttaaaaagtggccctgttgacacttgtgacctcaataaaagagatattttaatgttaaaatgtcttaaattaatgttgaaaataaaagtattttttctcatcccacctaaagaaggagggattttctttagcttcttcttgatcttgacagcattgctgctgcatccgtgactctggattcagtgtcagtgatacagtaggtgaccggtgacttgagctgggggctaggttatagcatgcaatgtaaatagttatttgtcacgtggttgacaacttgccagctgatatcgtcaaaaaatttcttatatattcaagtggggcttgtaaaggtagttgatttctccatgaaaatagctgcatattcaaatgactgcctttgtgaagttttctatagcatattagattatgtttagcagtaatattggcacttaaaagatatttaatattgtcaaaatttagagttttaacataatgccattttagtttcaatttatttcaaattgcagaacagttaatactagactcagcttggagctgtttttgtaaaagatctcaaagagactatgttttcagggctcaagaatagccatatttcctcttagtgtaggcctggtttcctctgactccccacctcccatgttgaagactttgtcagaatgtctgtccgctcactcatgtgcttccttattttcttttgtctttgtctggcagaagcctagtgtacactatattgattatatatacacacacaaatatatttttatccccatatatacacacacacacacatatatatttatatatacacaaatatatatttgtctccatatatacgcatatttatctccatatatacacatatatttatctccatatatatacacacatacatatatatctctatatatgcacatatatatttatatatacacacacatatatatctccatatatatacacacacatacatatatatttatctccatatccatatttattcaagttgggtttgtaaaggtagttgatttctccatgaaaatagctgcatattcaaatagctatctttgtgaatttttatatccatatttatgtatatggagatatatatgtatgtgtgtgtatatatatatggatacatgtatatatacacatatatatggatccatatacatatatacacatatacacatatatgaatacctatatatatatacatatggagataaacatgtatatatataacatatatatatataatggaaatatagacaactgcctactcttatctcttctgattggtagtttttttccatttatatatttgatcaaagaaaattaattgaggaataatttattctgggccatgtgtggttattcagctaacagtgcatattgggagccttggggtaaaatagattatcagaatctttgttcttttcattgagtttgagttaatatttaaagagatttttatattgggattttaagtgggaataactagcacttgggactggaaatcagtagattatttgggtgagataatttgtttataaatttccattttaatttaaactctgatggagagatttcagtttaaattctcagttttttacccctttttcttccagtcatctttgaggtagcctttgttgctttagaaccaagctgacaaaaatctcagtatgtacaaaatgtttatgaatttactcttgtgtccagggacttaaatgtatatgagaatggtgcaggcagaagggaagacactggctgcaaggctgacaaacatactctgtgttctttttttgtggcaaaaaacaggaaaaaaatagtagctaaaattaggagctctgttctcagactgcctgggtctgaatcctagatccaccagtggtctggttaactcaaagaattatttaacctctctaagctataatttcctcatatgtgaaacaaggataaaaagagtgtctgttttatagggttgtgaagattgaaattatcaaatatggtgcttggaattgggtagagacactcaatatatggtagttggtagcattgtaggaagtgaatagtaatagtcattttccattaatttatttacatgctttatcttgtgtaattgttaaaaaatatcaaatgcgttcctatgtgtcaaaaggcctaaatagccctgtgtacctaaaagatggtaattaattttggtggttggtttgggtgaaaatatctgtcactatttcaggaaaatacaaaaaaaaaaaacaaaaccctgatattaatatccaggttatagtacctataactctgtcatag

SEQ ID NO: 3126 - DNA, 4209 bp, Homo sapiens
cccactcctgcccgacctgcctgttaccaagataaagaagcaggtgaccagcatctggcatttggcaaccctgactcgactccaaggccccatgacggttcctctcctctcctctcctcccctcccttcccctccctgtggtttccagctgggcaggggcctcagaccgcagctcactgcccaggaggtaggctgcatccgcccctctgtctgtctgtcaacatcgccctaggaccgagctgctgggtgccccggaagaagggcaggcaggaaggggaggggcagtgaggttggctccccccaccacctcaccctggtgcccccagcccagcccaagacaccagggcatttgctgacatctgaggcccttcccaggaagacatggcctcgttcttggtgtggccactgaggacggcgctgagagggggaaagtcatgggcaggacctggtgtgggatgtggaggagacggcgcccggggaggaggaggtgagctccccgtcctgggagtgagcaagtgtggactgggccttgggggcgtaatccttggaggaatttggatggggtctccttggaacatcattattgaggtgttcttaggaaacaccctttgaaatgtcctgtgacagcttaagttttgagaaggtcgttggttttaatgccttcgtgggcggcactcatggatattttgtcgcagagccttcttggggccacaggggtgggctggggcctcgctcacactcacgtggggcctccagggggaggctttgtaaacctcgaatttgcaattacaccgagccgtgtaattacgtatgggtgggggcagcgctgcggccccagtacaggcagggtttccgtgggcctctggggcagggtgggcctgaagagggtgaaaatgttccaggtgaatccatcattcagggaccactccgggccctcccaggagtgctaacaggcggctctgctcgcccctcggtgctggaattgctcctcctgcatttggtcaggacctcatcaagggggagggggccccaagacctgcaggcatggcaaccccagcgtggctgtgggaagagggcccagctgccgcccgctcaggaacgctgctggaggaactgctgaggccaccgcctccctccctctgcggagggagaaccaggagaaccaggagggacaaccaggacccccgtccagcccagcacccccaggcagcaccctctgcagctctggcccccaggaattcccaccctgagtctgtgggggcttgtggagacctcagatgcctggcacccacagtgtcacttcagctgggggcctaggtgtggctcagactggggcgcaggtatgaatgtaggggtggcaacaagagtgaaggtaccaggtctaggggcaggaggcccccgggctgtgcaagtgggcagcccgtcctctccagggaagatgagctgctcttggctatgtctggttcgcccctagaattgtctctctccaaccttgacctccctggagctggtgaggcgggcctggagcaccacccgcttctgggacacctcttcatcaggtggcctcacttgtcatctcaaagtggcgtcgaaccccctgacaggtggacgggaacccccggctggccctccagagaccaggaggcccctggctcaatgatgccacctgcagctgcccaaccctccgcccatggtgcccttgttccacctgccaccgctcatgaacctgtggatcacccagctctgcactggcttgcctgctgctgctgtctcagtttacctgggcagttgcccctggctatccggctgggatgggacttggacttagaagcaggcccctcctctggaaagctgtgtcctcgggccaggaggtggcagcctctaccttcctgagacagggacccttttctgtccatcagaggacagctgtatgaagacacagagagaaggcagccatctgtaagccaggaagagagccctcaccaagactggaatcagcagcaccttgatattggacttccagcctccagaactgcaagaaataagcacctgctgtttacatgcccagcctgcagtgcttccttatggcagattggagctaactgagacagctcccagcactcattcattcattcattcattcactcacctcatgtctactaaacagctctgggctggctctgggaagcagtgagtcacacacactgcccccagcaacgtgtgaaatatgtttagagacagtgggctacagcggaaagggtagatgccctgagaaccccagcggtgctggtcagaagcacaggccttgttgggctgaggctggcatggggtgaacctggggagcctcgggggcagaggtgatagatgtggggtgtttcaaggcagtgagacaaagaagggagatgggtggtgccccccaatgccaggcttcaccagcctcccaacacacgagtgttcacccgcctggatgagacacctctgtggacttgggagtgaaggcagtgaatttgggcaatgctggaggccgtgcaggtgggaggtgggacaggggcaagaggccggggcccaggcaggagctgacagcccaccagtggtgctcccctgagaagcaacctcagtgggtggcttggggtctgctgggctgtccccacactgacaccctggctgcagggcccccctgtgtccccagtgaggggtctcgggagctgtgtgtcctactcagggccatccctgcagcccatgctctctgggtgaccagttgccagcagtgtcccccctgccttgggcggaggctgaggaccccagggtgggagggaaggtgcggtgggggctcagccaatgctgcccagcctgagggtccctcacatgtgggccgcacccctgcgtcagccggagtgatctctgcttagggtggtttgaggtgagttctgatatctcaaacaccagcatcagggccagggcagacaaaataagagtgagctggtcaggggtgtcccagttgggagctcgctcacagtctttaaggaggcagggcacagcccagtgggggtggccacgaggccccgggcctgtggctgagatggcaactggcaccggcagtgattggaacagtccagcccatggagccctgtggccttggccggtggctcacggtgccacgggagctggagcaatgggtggcctcccttgcctggtgcctgagtgaaggaggactgggtgcccctgaggaaggaccttgccatactcctacaaatttacattattcttctttccccagtctcccctcagggacctgcagccatttgctggggtggctagtggaaagggggatcatcagactcagggggattactggactctaactctaacctgacacccactcctggggacacaaacacccatcggatctaatagtcagaggaggggcgtatggaggtcagtgggctcacggagttctagctcaggtccaaccctcggtgggtgcagaggtcacttccctagcctcagatgggtgagtaaacagacgtatgtggcagccagcagagcccccacatttgttccctgacctgagggtgggggctactatgctgggaaaggccaggtggaagccattggggtgaactctgcctaggaaaattgtcagtcaaaagcaacctgcagccctggagggactgcaaaggtcagtgccgccatcgaggacttggaagatgcagggtggtgacccccactgcagcctcgttccactcgtctaattggcttgtgtggaagacaggggggtcccggagaaagaaggacagtgaatcctggtaaacttaaccaggactccaattgcaactgctgttccagatatgactactgatcactggggcaaatcaaagcatccccggacacctggtctacagccattgatctggtgaaagctttaatttttaatatagattttattttttagagcagtttcatgtttacagagaaattgagcatatttgagagtcctcatatagcatctctccctacacacagtttcccttattattcatatcttgaattactgtgatacatctttgcaattgatgaaccaatattgacctagtcattgatcaggttacatgagggttcactcttcttgttgtacatgctgtgagttcgggcaaatgtgtaatggcatatctccactattacagtgtcacacagaattattttactgcc

SEQ ID NO: 3127 - DNA, 2788 bp, Homo sapiens
caaaaatgaactgaagttaggagaagcctccatatgtttatcctaagtatggtaaactatttaagaaacagttattatttcttactggattgtttgttaattcataaagttaggtcataaagttgttaattctgtattggattgtttgttaattcataaagtaaaaccatacagtgggaatttggaaaaattacctcttattttcttcacaaaataccaattattttgttttatgtaggctccttgaagttcgtggaaggctgtatgagcttctaactcattgtattcctcctgagataataatgaaggctgtatcccagtagaagactcaaaggcacctctgattgtctctccagcatagtaattctggaaaccaagatctgtattttgttctttcccataggccatgtgctctaagggccgagatacaggactggcagtaacagtgggtaccacacatggctaataagagtgcagaggctgagggtatctgaagaagacactgatttttggccaaggtctggtgaatttgcactcgtggctgcagaaatcatcctggcgcaaaacaagctttaaatctttcatttgggggaaacgatcatgaaagtgcctagaaaataagttagcacatgatatgcttctttttttctttttatttacttgacttaaggcaaactgttgtagtaataaggaacattgttttccacttgctcatctccagtctcactttgattgtgtgtggacacactgccctggctctcacaagtagcccattagcagtcacatctttgtgcatctggggcccagactgctgttttctctgctgctaaacaactctatttccttccctaacctctacctcttccccagcatggaatgatggtccctgagtctttatttttgtcatgaattaaggattcttacctgactgtatttgctaactttacaaaatgagagaatagtgaccacctcaagtacatccgagaacaattctccaaattttaagaaagtaagaatatgcaatgtcaattagtggaaaactatacaaattatttgatttatcagaatagattttaaagatgaaaaaggctcagactaattaaaaatgagcaaaagtgtagacactgtactgaagaagaaataaaggtgccaaataaacatataaaaagttccccttcatttatcacttgcatatttcaaattaaaacaacgagatatcactatatacctttagaatagctaaaattaaaacaacagcagcaacaacaacaacaaaaccctgataatactaactgatggcaatgatgtggaacaagaggaactctcattcattgctagtgtaaatgagaagtggtacagccactttggaacacagtttggaagtttcttgtaaagctatacattgtcttaccatataatccagcaatgtaatgctactagatatttacttaactgatttgaaaacttaaaaacctcgtataaatgattatagcaacttcatttataatcacctcaaactgaaagtaaccaagacgtccttcaaaggtgaattgatgaacaaactgtagtatgctcatatagtggaaactattcaagaatgcaaagactgagctatcaaacctgccaaggtatggatgaatcttgaattaatattgctaagtgaaagaagctagtctaaaaaggctacatactatatgattccaattacatgactatatggaagaggcagaactatggagatagtaaacggatgagtggttgctagaagttccataggggaaaggaaaagagttgagtacatgagcataaagaatttttttagactggtaaaactattccatataatattctaatggtagatacttgccataatgtatttgtcaaaacccatagaactttacagcaaaaaagtaatttatgcaaatctttaaatatctcttaagaggtctggaaatcccaggattgaatatagaatgtggcaaaattatcccaccatattacaaatgtacgaaacaagctcactgatgggcataggagtaaaggtgctgacctaagtaactttgacaatgagtggaatctatgagactaaaggctgaaagaagcacacagaagcactgcactgtggctgataaagttgctgcccaacaggtatgtggattaatgattctgaaacccctatacatgtatactagaattgaacaaaaactaaattaatttaatgtatatgcatgtagaattacaaatatattttcttgctctgtcagcagagggggcctagaagcaatgatattctgggagcagagagcctacctagcccccagattttggtttctgataattattctctaataaaatgaaccaaggttctttggagaagcgactgattgtagaatgaggacaggaaatattcgagatgaacttggagtaatttgtgctgcaagaaaataagaaagtgccaaaaagtagttgaaaaccccacaatgatggggtataccaaagaacgtaggaagtaactgaaagggttcccagtgaaagaagcattggattataaacatatgaaataaaaattcacaaactcatactgatatagaaaattatggaatacaaactatccatctgggaacagatatacacaatggaatattaaaatgaagtcctgtaacttgtagcaacataaatggaactggaagtcattatgttaagtgaaataagccaggtacaaacaaatatggcacgttctcattcatatgtggaagtggatctcatggaagcagagggtagaatgggg

SEQ ID NO: 3128 - DNA, 3507 bp, Homo sapiens
cctcgtcccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacacgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcaga

SEQ ID NO: 3129 - DNA, 1941 bp, Homo sapiens
ttttagtttgcctattatctagccagtttttaaatatatgtacagatggttcttgatttatgtgattcaacttataattttttgactttatgatggatttatcaggatgtaaacctatcataagtcaaggagcatctgagtatcccatgtatattcatgctttattacacaatgatctgattatttgtcagcacatttttaaattctctaatgaaatgtgtggcttttgtttatagactgtggcagggtataccattcctccaggacatcaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaaga

SEQ ID NO: 3130 - DNA, 1269 bp, Homo sapiens
aagagtttggagatgaaggttaatggactgatggtgatggaaaagatagctcagagatatttcaagcaggctgcaagaatctcccaatttcgtccatcacaaatccatcgttgatcctggatgcaggcttcagctggcaaaggaaaggaaatacagagttcaaagcaagttttattgttaagattacatagcatccttcggttctccaatttgactctgggaagctctgttcccaagctaccaagtgtctgagactacacctacttgctcaatagcttatcatgactaatgaccatggatgatgtccctgaagacaagagtccacagatacacattttggatatgccacctagagatgatgtaagtgttgtcaagtttcctttcctggattttatgttcttcaggatgagaaacagaagtacataatttggcaaaaagaaaagtgattctccttttgcctaagaggcaaatgttttagtgatgtgcacaatgaaaacactacaaattccaactgtgacagagatggagttgagatgttgttgatcacagcaggaaatgtcatcataagaattttgtaaatgaagatttaataagttcatgtggatagaccacttagaacactgccttccacagagcagatccgaggtaagtgtttattattaataagtgaaagaatatttcaggttttaccaaaactataattaaaagcattttaccagcctagggattcaaatttaaaatctctccttgttacagtaattttatgcctttgtagcttagtttgtatttccttgcatgtgaaataaatattttattaaattggatgttcacattaaccaaataagtcgaagtataactaaccgtcagtaatttactcttgtgaaggtcaccacatgatttatcactttggacgttttgtgagttttgaaggtagacttgcaataatgcacacagcactagtgcaaaacatagacaactttgctccattaatcatctcactgggaagaaaataagagctggtgtgtggttcttaataaccacaaagccaaatgcaataagtctggttacccagatgtagctgatctgttcaatttatttcaccacatttagctcctgacctaattggagtcagttctggaatattgtgcaatgccttaggaagtccaggttggggagtgctggtcgcatagtacacaccatctactgctttgcattttgtttctaggatttctggaattcagtgtatttgagtactgccaaagtgtgtcc

SEQ ID NO: 3131 - DNA, 3191 bp, Homo sapiens
ttcagcttctcacttctgccaatgctttctctaagtatttatttttcatttctatgcatgatgagaaagaagatgaaaagagcttagggttccaatgaaatgttcgcagagatgcagggcaatacacaggaaacacacagggactgtgttatgcacttcagatgaggaatacaaaatacaaaattccttataagttgtggaataaaagatgcaagacaaaacaagcagtgccgaagacacacggaccacattaatcagaaagaagcagggtgctaaatgaagaggccaagagatcctcttgggatatctgggattatttcacagagaagaaacctaaattcttaacctagattctcaaagtatgaggagtaagcaagcagatactgcgagtagagatgacaccaatgaaaacacaatggacatgagaaaataagggcactgcaaacacaattacacacccaaagcctaattttcaactaaggaaacttgagtcccagactgcccagcattgtaaaatgtacgaagagatttaggttttattcttcagcagacaaaatgcactgactttttttgtttgtttgtttaattgaggagtggtatgattccataacggatttaaaagagtaaatgtgttaggactgggagattgattggcatgggaagatgatagcaaggagaccaggctattagaggagtagggcaaacacactctgatctgatctgagaccatggccattttctttcaaaaatgtttttggaaatattttatggttattatttttaaataaaatagctcctactcttgatttcactacaaatgttaaaatattgctatcacttataagacaaaaccataggctaatgtataatgcttgtaatagagcatacttggtaaatacaaaggcacagctgctttaattaatttctatgagaaaagtaaacaaaaattttgaatacttcatgcaaagtataacaagcttataggcttttacattttccagttcacattgccatttctatctaagaaggacacacaataagatggaagaaaacttgctttaaaatctttattttaagcagggacttaatgcagtgattttattctcctaataaatataaccccacataagagctgtcaccatattctgtaataggcaccaagtttgagccaaactaattagcaataaatctgccagaacccactcaaaatattctcctaattaatcagaaaagaaatagatgaattgaaaaatgttgttatcccatgaaagaaattttatcatcaatttctgtggttacttaactgatttgtctgtcttcatactggcacgcccatcagcctttgctttataagtcagttaaaaattttctgattacttgggatgaagggattataaaaagctataagtaccaagtgatcatgatttttagctggattatatttatttgtttgagcacacttcactaataaaatatttttcctgtatttcatatactaaaatagttacctccacttttttaaaatctttagctgatttctgtttttaaaaccctcatttactttttactgttttggttcttctgtgtaataattttttttcatctcttcctcaacagtttccattgaatgttttcagaatactttcatctaaattttaaatgtctcttgagtgtagctaattaagcttcattaaagcataacaatctaaatcttaacaccaataatgagcacttaataaaacaaagacaaccttccatttgaagattaacaaatttgctctatatgttcttttccaggctaaggaaacagtctgccatctgatataaattttaccttaatatttgtacctttattactttattccatgcttttaaatggttagaacatcatgggcttcttccaaaatttctgaaggaaaaatattttaaagttctcattagtcttcaaaagcataaagtatggaaaggtgggaagggtagggagagatgtgactttacagcagagaaacgtgccaaacactacctcaacttcatggtaaagactaacatcatcagtgaaaatcatttcaattgtgtttatctttgatattaagtgttaagaatggtacttatctttgtattcattatccgcaaatccccatagccccaatctaaacctggaaacaaaaaatcagacaaatccaaactgatactctacaaaatacctggccagcactcctgaaatatgtgaaagtcatcacatactttgatgattttcacatatttcttacactgagaaactttgcaagaggaaggtagtacatatgataattaatgtaatgaggtatcctggatgggatcctggaacagaaagaaaaaaaatttggaaagttcaagtgaagtacagagtttggttaatggcaatgttaccaacattggtttcttagttttgacaaatgcaccatggcaatgtaagatgttaactggatgaaagttactcagaaactttctgtaccatctctgcaaatattctggaaacctaaaacaattctattttttgaaagtttattcacaaataatttcataagaacagataatcaatatcacaaggtaattgtgaaaacaggcaaaatagtcttatgtctattcctgataaattatgtattgattattaatagaacttccacatgcattttatgctataaaatattttgtacagtagatttatgcctcatgagttaagttgtaatccaatggcaaggggaacattttgtcaaagtttctcttgacagtacattaaactacccataaaatatggaacatattgtcttatgtatacaacatcctacagagttcttgtaaatccttcatagtgtttctccatggtatctttcctaataaatataatccttcaatgtaattttcaaatggcataaaggaagtttccatcttccaaccacttgcacaaacaatgtgattcatttctttctaaatgatctggaaactctttgcagaatgtctgctctctttccaaaggcatcaaaatatggacttattacttaagattccattgaatttactctcagaggcacatgctcattgagaaaaatgctgaatcatcacctctcacttattattatggttctttatttccagaggttcaattgagttctaacaggtatacatgtgactccattgtatttcaaaatggt

SEQ ID NO: 3132 - DNA, 716 bp, Homo sapiens
gctagcgctccgcgggactgggaactctgcagccggtcccggtgtgattgctgccgccttgggagcagcctccgccgcggccgccgagttccaatggcccattggaaccttttgctaggttttggacgcttagcagaactttgacatcgctggaggcgtggagccctgttgcactcgaataatggcctctctttgagatgattcacgtctagggaacactggaaaatgctggattcacagtgcccctttgccttcgaaaaacttttacattggctttaagtactttatttggaggatgattctgtgatcttatctacactgttcacaaggcagcacttacacaggcccagaaccatggtcatgtaggattctttcctggggaaacaaagtaaataaactgacttttaggtgtatctgtaggatggattttttacaaacttaagaattatgtttaggaagattaatgactggggaatacaaaaggaagtggcaacagtgggagtccttgtattgtagactgaattatcctccaaaaagatatattgaagtcctaaaccttggtatctgtgaatgtgaccttatttggactgcctttgcagacgtaatcaagttaagatgaaatcatactggagtagggtttgccctactctaatatgacttgtgtcctcataaaaagggaacagacacagacacacgcacagagaacaccatatgag

SEQ ID NO: 3133 - DNA, 4937 bp, Homo sapiens
agagcggcgagcccctccgcggctcggggtgagtcgggcgcggggcgcagaccgcgctctgacgtcgggggcggagcggccgtgacgcgcgggggcgggtctgcgcaccttcccggcccagccggcgattcattcaaaaggcgcgcaggctgcgcggctgtccgggcgctcgccgagccgggccgcggcgccgagtcgaacggggagccgagctggagctgccgcggcgcagccagattcccaccagggcgaacccagcaccgcctgtataccagactctgtgccaggcactgaacgtaaataaaaggtttgtgcccttctcctccacattccacacgtagggaaactgagtcacagtgaagtgtggggaatgcttactctgtgccaggcctgtgctgagtacttaatgtgattctcttctttcagccttaccacagccctctgcaggcaggccacagagccagtgcaagacagagcagagcaggactgcaccccatactttgtatccccaggttagcccaggggttcagatctgggttctgacccaccccagcctctgggctccttccccctcagcctgctcactggctcttctagctcggcatagctgggctctctaccaagagtgccttttctgccttctcccccaaatcagcccatacccgcccaggtcggcactgggcatggagcaggcagctcgtggtggggaaagggctgggtaataggatctgcatggcaccatgaatgctgagggggaggtgggggagagggtacttccaggaggaagtgacttcgagctgagctctaaggaagagtgggtgctggccaagcgatgaggggagagcagaaagcaggtgcagcgtgtgtgagggtggaaagcactcagcgtggcaggcgtgtgggtgggggaggttggtgggggcgcgtcacgacgccatcctgagggtggtgggagctggcccagggccagggccagaactgggtgtcagggcacctaggctgcagggcgggactgacctggaggccagagacagggcaagggggcaagagcaatgggcgcaggccttgggagagcttagggactgtagggaaggggagggccctgcctaggggagggggagtggcgtggcagggcccgggtgaccccagcgagcttcagttctgggaaaggggaagctgcctgtggcctgggctggtggcacagcttcctctttctctgaggcctccaggctgcacctccctggggctccaccatctgtggcctcaatcgtggtctggggccctcagcttgggggtctggccgtggcctttgctagttggcttttctccagggaatttctggttctcattgttcgggcatttttttggagagctgagtctgaggaaaccctccccgcctcgtgagcctgcttggaggcctcccgcttcagacatggggctgggtgtggagttttgtggcaaataaaacagacgtccctgccctcaccactgtctggtgggggagcaaggaataaacaagtaagcaaacaaatacttaatcacagccctctgccagcagggcagaggagaagggctgtggagaaggaaatcccatgacctactttagcttcattacctcctttaaaccccatgactggctgggcacagcggctcacacctggaatcccagtactttgggaggccaaggcgagaggatcgcttgagcccaagagttggagaccagccagggcaacataatgagaccccgtctctacagaaaataaatttaaaaatttagccaggcatggtggggcatgcctgcagtcctagttactcaggaggctgaagcaggaggatcacttaaaagttcaaagttgcagtgagctgtgatcgtgctactgcagtccatcctggatggcagagtgagacactgtctcagaaaaaacaaaacagaaattccccaaaaacttcgcgacagccatgccagcaagatgaacgtccccatctctgtagatgagaaaactgagacccagtgatgtgaaggtcccaaagggagttggtggcagtggagactgggccccaggctaggagacatgggaggagtggcctctaagccaagttccttctctgctacccccctggggcccctcctccccatccagtgtggctgggtgtggctctcctctgtcaggcatcggaggctctggggcctcactgactgcccagcctttaggatgaggcagagacggatatgggaccttcagatatcccctcccagccgagggggcttccatctaactgtttttttggtcacggttccagggccgttttagacagtggaggccttgtggggcagggtgtgaggggtgctgagcagcaggtgtggacatgtgtgtgcaccaggcctttctacctgaccgggcaagtccagtgggggctcagtctgggctgagtgtgggggccgggcagccagactggagtaagtgctggtttggggtaatgagaaggtgcgtaattagaaggtgcaaggccctaggtggcagtgtctatgcgtgtgctggagtgggccctcgttggctttgagtctgggcctttggaccccgctttcttcctggaaggttctagatcacacagctctgcgtctgtctgcagatgagcagctgcacagctgctccctgtgggctcaggtcacctagcaggtgccacccagggttggggtggttctagggctctctgctgtggttgcttggcctcttttcacccccgcatcagccctctgggcctaccttggggacatggagggctgctagagctgggggctgggctgttgggttggtcacggttccccctggctttgtcttttttttttttttttgagatggagtcttgctctgtcgcccaggctggagtacagtggcacaatctcggctcactgcaacctccacctcccaggttcaagcgattcccctgcctcagcctcccgagtagctgggattacaagttgtaccaccacactgggctaatttttgtatttttactagagacggggtttcagcatcttggccaggctggtcttgaactcctgacctcgtgatccacctgcctctgcctcccaaagtgctgggattacaggcgtgagccaccatgcctgccacagcctgcccccacccccagcatcaggctctgtcttgcgtagtcaggcctagtggggaagtgaagcctgaggacttggggctcgtggtcaggtctgtgggttagatccctcaaaggacagaggaggggccatggggagacaggctcgaggtgggagctgggccctgacaagggcacaggacactttggggcagaaactggaaggaagacttgtgaccaaatttaaggagtgacaggggaccctccccaaatagcctgggggtgccatctgttgggtgttgactgccaggtgtggcctccaccctatactgtggccctaccttctcctgtccctggctttcccctgagctggcctgggacccagagtggctgccagtgacctggagagtcctgagatgatgtaactgctgcccactccctcccctgagtgtaactcaaaccctgggcccctctgagatctgccaagagggagggcgggtggacagatcggtttcctgggctgctattctaggtgggagggccgggctgcctgcagggagaggactctgagtgatttgggactaccacaggaggcgcttttctcacctcaccggccttggagtcacagcgggggcctcagccgcggcggccctgagccagtggctgggttcccaggctgcccctgggcttaagaggctgcgtgtggcctgaagagcacggctttcctcagcctcgtgcccctgaagccaggcctccaggaagtacacagcggacttccttgctctgccacctgtcccttctgctgtctgatgtgaatcctttgtcctgctgtgtccgcctcgtccactggccggaggcttctccagagcaggccaccgtctgggcctgggggcctcagtctcagaccggtgggccgtgacgccaccatggatatttctctgaagtatcacacactgcactcccactctgctttatttcgtttcttggcacttaccaccaaatggcaggggcacctctctgtttgcagttgggtctcccctgggatggagctccctgcagacagggaccttgtctgtcttgttcataccgatttctccagtgcccgcacgcagtaggtgctggagagatgacaaagacagagcactggctgccgtgaccaccccagccccataggtctgccaggggaagagctgtggccagacatgttccagcctcaagggaggagtcagcctccctggaagaggtgtggacagtggccatgcagaaggaccaggacctagatggggtggggagctgtgggagccagacccactttggggaaagcttctagagaagcttctggaaagagaggccttcgtgttgagctttgaagggtaaaggaaaaggccttccttggaccagaaccagcaggagtgaaggcagaggccgggcatgcttgcagacctgtgaggaggaggcggggggagcctgagcctggagcgctgggctggagtgtggaggccgggctggggtgttgggtgttggttgcaaccctgtcatcacggacacaggccgccacacgcgcttccttcccctgctgatgcctcggggcacctggcagtttaaggaaggggaaggaagcccttcctcctctgggaagcctcccagcctgcagagccttcttcctgccttcctgcctgtgctgccccgtgaggccggctcccaggcagggcagccccctctgcttgggcctgtgcttgcgggtgtggagccggcctccccgggctctgcctgcccagcagcaccttgcctgctccccatgagtcctgtcatcctggaagtggtgc

SEQ ID NO: 3134 - DNA, 36726 bp, Homo sapiens
ggctcactggcttcttagcagtagctttgctgggagctgcggtattccaacagcccctagtgtcggctgggatgatgtgacttgggggttaaatgcagtttgcagtttcaaaaaagaaaagcatgatttgttgaaagaggctcctgaagaagaacatctgcgaagaagtctatctcccatatggcttttaggacactttgcagtatgctcagatcaagcaatatggacctgaaaaggaaaagaaaaaaaaaagaaagcaaccagtctccttcatatgaaaatctctgtggcattctgggacataattccatacctgtatatacagatctgccttgctctctttggtggcttcagaatacttcattgcaagtgtcccctaactttttgaaccagtcttctaccaatggatatttaggttgtttctaatcttcagcaattaaaacagtgatgaaaggaatatccttttatcatctttacatatataaactcagatccctctactttccaagtgtgagaagattttgttctacagtcgcttctgtgagatcaccacagccctggcaaaccaagagggaggaaccttgtgcctttgaagtgtgattcacagtgcttgataaagtgccagtattctctaaacatcatgataaatgtttccaagaccactctgctagattgcttgtagcttaccttccagctcctgccctttctggttgctagagacagttttaggttcacagcaaattggatggaagttacagaaattcttctatttttaattttaaactaacatacgacaaaaggatttcctgatttatccaccatttcaaaaaaaggtccgaagaaaatgaaggagcctcttcctgtactcatggtacataaggtaacagaaaccacagaaatcaaaaccgtggataagaggagactacagaaagatttctccttctggagtacatgaatcaaattgcattgaatcaaaagttttgtgaagatttgagatgagaatgagagccaaataagccatatcataagaagctgtgatcagaaataaaatgaggacaatgcttactgtggctttcaaggcaggagaaagcacacccgagggggtcgtgtcccacactaggcagatctaatggtgccacaaaagacaggtgttttgtcagatttcagccacacactttcacacctgcaacgcattaactaccgcagcaatgttaatgaagaccaggtgcctgttctccagcataaatgaggaactggcaggagatttgctgtttgctacctgacgtctacccctgagtctctgaaccccgtccttctggttgaaggggaagatcaaagagtattttgaagaaaaagatgtacagggaatttgcttgatgctaccaacaaaaaacgtgtagtgatgtacaaaaaatgattcctgttggacattcaacacgatactccaatgtactttgaacacgtcatgttctgtgaaggtaaaaatgggcagtgactgctgtctctgtgtacttcggaacatttctttctgagcctataaagtgtttggctggcatgcaggggcctgaggaagcttaaggagaaacctcgtcccatgacacataatcctaccacaccctgaaatggatagatggttgggtcatgccagtgtgcacacacagactggtaagtggaagattagccagaattgtgaaagatgctaccatacagccacccagttctgccaaaggagaaggtcacttgccaacggcaaatgtaaatggccatgaatatcctgttctctttctgtcaaagttggttctgagcactgaggggagagacagaattaaaagtagacacagcagcgagtaaagctatctctgtctaatggagtgtctgtatttttgggtacatgatttttctatacctgagatgaataattcattctcaaggaaccccaaagcaaaagtttaaagatgattaaaaaataactttggcttctgatcttctgataactgggaactctgtgatagagacatagaaaactattaggaattaaaaccaaaacaagaccgggctttagggattcccctcacactattatactgtcatggaaggctcaggataaccaggctagccgtacataaagtaattaataaagtaggtcaattacaaagctagaagagttttatttagcgtgatattgatcacatcttgaatcatctccctgaatctccgtatttttcttttttattaaaaacagaatagcgttcttgaagaattgttttatctacacttctgtaattgttctctaaacagagaattgtttagaaggaccagttccctagcaatatatgacctttctaactatacttcatgtcatctcatgcaggccctatcttctgtaaaattaggcctccattgtgtttctcactcaagattcttctttattatttcccagattctctggatggagcattttctttataaacaacatatttgtgctcatctgttgtggatgctcttggtgccccatccagacctcctttaccaggctgatgcacgaacactctagcttctaagaatgttcactgttagcttatagattctccttttctacagagtcacccttggctaagtaggagccactatatcctttagtatacattaccagcttatagccattgattaagggaagacaaaagtcagcccttgtctcaaggtagggccaattctgaagtgaaattcatgctccagagctccctgtggggccaggctacagttagtttctagctgggccacatgcatgcttagcttgttttgccttatcctgctgccctcacttctcttcccctgagaacactaacacaagagtccctgtccaggccctgcttcaagggaacctgccaatcatcatgactgtgaacatttagggcaggtgggtaggagtctgagagtggtaatgggattggagggggtttagcacataatttaccctaataagtgtttgctaaatgagtggattttccaggcttgatgcttggattaaaagtagcacagctgtcttcaaaagatctatttctcaagcagggctgggctccctgattcactcctggattggaaacaaaataagtgggaaaatttcataaggcttattgtcgaatagaaagacattgatgattgttaatgatgttaattaatcaacagggattattaagtgccagcttttcccagcatgtgactaaacacccaggtctgtggtaactgtgatgaagaaaataacctcttttatcttataaaaaaaaaatcttatcttcatgtggagataaaacttactcaaatgaaacaatgaaaatataagactgtgttcacatgacaaaatgtacttcataggtaataagttccaaaggaaattcagagaagtaagaaatcaatgtgggcgtttgtgagttaggcaagtcttggaggaataggtgtgtgtgggagggacaggagagaagacattccaagtgggagaagaggtaagaagaaaggtgtggagacagtaatgaggatactactatttgccaggagatataacatgagaaaataagttccccctgagttcacttcctttttatatttccatcccattatcctatttccatttattcttcattcatttattaattcagtaatcaaatattctttgagacctacactgttccaagaactgcattatgtcttagggatatgggaatgaaaagaatacccatcattgttctcaaggaactgacagtctccagagagataaaattagcaaacagacaattacaatacagggttgtcatggtactttaagagtaagcatagggtgctaggagagaacaaaggagaggcatggaagccagacttgggggaaggtccaaaaaggcttcctgaagaagtgacatcttattggagacataaagagtgggtagaatttagccaggtgaaggagagtgcaagaaaataattgtggggatgcatggtgctttgaggaaagtgaggggtgcagtatcactgatgtgtgtggaggacagaaagaccaagggtggacaataaacgggccagatcagggaccaccctgtaattaaaggagtatggactgcatctttagggccatgataaccattagttgactaaagtattaaaattacttgatcggattatttctgaaacattactttagttggagtagtttgaataggttggtctcgaccaaactggatgctgatagacatgctaagaagctttgttatgcacatggcaaatgatggtgggaatggagagaagtgaaggtaaagtgacataaattggagtttcattggttttgggagaagagaataaaaaagtcgagaataatactgaagaatttacattaagcaactagggtggggagtaatggtatcttcatcaagttagggagcatgagaggaagagtgagattggggaacagatgattactcagtttttgacgtgatagttttgagaatcctggggataatcaagcagagatgttgaataggtgggtctggaagttagaagacacttttggggtggcaatatagatttggggtttctactaataaaccactcactttacttccatcctattttgtttagtggtaccaacaccctcttatttgctcaggttagaaactcatatttccctaaggggtccatggatgggcttcataggattcttgaacctccttgaaattgcatgcacaattttgggtataagtgaataagtgcctttttctagtaccatgagatgtagaattttatggaatttgcaaaaggttacttgacttccctcttgtccccccaaaacaaagagaatccaaagtgacttggggtctttgtctcttttcctctcttctttatatttactcatgcgtcgtgttcttcagtcttatctttgaagtcatatttatatcccttatctttcctcattgctagcctcctagttcagatccttactgcttgtaactttaagaacttacattggaatccctcaactttctaatacatgtaactgcatattttttttctccaaactgctaccaactatattagttgagttcccacctttatgggcagcaagaaaatttaactttgtcagcccctcctggtaatcatcagcttagtttactgattttttgcaatccagttattaaaatctcagactctattcaaaacatcttatctttaattaaattagatatgactaggctgctagaagctgattgaggaggagtagagtgtaattggttctttacctcttttcttctgatctcaggcaactgttctgctgatgggggtatcagagaggtcagggtgactgaaaagaattcactcatgtgattgccagcatgttgaagatggcaagctggcaatcttttctttaaagtcagccaatacctggtctaatttctgggtggtggtaaccagcctccagttacacagcattacatcttaggtggtctttgatgcccagccagcagtcttatggaggtagaacagcttccttctctccctcctggtgggtggctctcagtatcctcctcacatcaacccatcattcatcaatatggcccacccatagtggtgcccaccccttatttggtgacctgggctaggtccacagaaaacttgggatcattggtacacctgcctcaatttgtatgagactgtgagggggtagcaaccttaatgtactaggacttactcatttactctctcttaggattcaacacccaaaatattctatgcattttcttgggactgttaactttcaggtgcagcaaaggttcataacaatcttcacttcctaatgatgctttcagatttcatgagtgattctccagggaacatctggcttggttgggcacagataaatagccaaactgcttccctctcagccccgttccacatggagagaagtaaatactgattcacaaactcacctcttcccaaaagatgactcctcttcccctctctgtttccttcaggggggctgctctactgattcttctgaaaggtcaccttgttagcaggtccccagtcagggatgtatggccttgttgtttttcagctttgaggtgcctctacttggtaactccctaggaaggagtctcagtatgtatcacaacttcatgttaccatcttttaactggtaaccatgatacaatttcttgtctctctcacatatttttcctaaatgttttaacttcgatgactccccaaggttgagacaaataccttcagactggcctccacagtcctttaaaattgtggcctccaagtacctttgcaatctcaattcttaccataagctctttgaataatatgggcaataatcaaacagatcctgccctatcaatgttccatgatgttggtcatgcctttccctttgcctgcaacatcccttctttaatttttattgaaaattcttctattcattgtttaggtcaacctcccatgtcatctccataatgtcttaccattctttcaacaggaatcaatcctgtctatgccatttgcagcatgcttttacttgtctgattctttgacatcataagaaacagtgaagtggcctagccaggtgccttaaacatagcaaatgttcaacagttcagtcagactgaaatgacaggggaagtgcagtcagatcatgtgaggagtcttaaatgactaaatgaccttggatactatttcagttgatttctattaaagacttgggaaagccaactttcactgatttttgcaatttatagaaatgctcccattgcaatagcttgtgagcatattgccaaaaaactataacaaaaaattcaactcacgaattgtgcctgtcttcctgatagggtgctctatgcttgttagtatctagaggacaaatgaaaaccatgtgctctggatctaaaacacaatcaacaagtggggacatggaatctaaaagaagatcaagtgtgggtgtcccccagaattaacaccatgcttgataccaggactcaaattgggcaggagtcagggtcagggtgggagggtaaagtgggtgttgtcgctagtttcagctgtggagtggtgaggaagcagaaaataaggtaaccaggaccaaattctggtagggggcaattaagttcagatggatgtctattggtggcttgagcatccaacattatacagccatgtggctggtgtcatcaggcatctgagcaactgtgctctaacaagtggtgtttctggataaacttaatcttcaatggtgagtttaggcagagggcttcaaagagggctcaggaacctctgagcaacacccgaagtctttggctacactaaaaagccctgatttatataaataaaggcttagatgttctttaaacagctcacttgacatgcctgaaccttataaacaatgagactaacgtaaatgtatggtgctctagaaatatttggaagatcatcttgacatacctaaattcaacttggcttgctaatttttaagagccagatctaataccgtacgtacattacccattccacaaataatcaaccacatatacctttggccatccccacacccattggatacgcacacagctgtcctcacatgatcttacacccctccaactcatctatacctacaaacagaagcacgtgcctatcaaatgcacacatcttcaccaaaccttgggttcccacaaacttttcttctcctccagcctatcctgagttatgcagctgttttaggccattctctgaccgaccagctatgctctaggtggaacagctgtggttagaaacttggccaggacttgctgccaagagccagttagaggtggttgagtgagcactattgagagtagctgtggaatgtgggtgaagccagaggagagtgggcacagctgatgtcccttctttaagaagacgctcccctccctccccagtgggatgatggagggcagctgtgtgctgatgatgcaaagaaaatgagacggtagcgcttagcttcagaggcagcagctgctgtggtctggagggcaccaccaggtcatccccagagggtaagcactgctccaatgcccttgtgtaatggtaggaagcggctggctcgcccatctctggttagatggcattagcaaagtttgttgagtttctttgagggccagtgtgtgatcatacatgtgtaaggacacacttcctcatacacatttatttgtacacatagacaactggccttggggataattttttttttaagatttctgactcgcaggaaaagctgggagttagcagggattggctaaatgtgtctgattcccttgcacacagcttctccttgcctgtgaagctaatgctttcactctcattgagaagcaagatctctcagttggagagccttgtttaggtcatctcacaccacactcaattttgtcctcttgctccagcttacttattccaggccaaaggagaccagggaagtcagggacctttattattgctgggacccatttgatatttggagccgataaatgagatgtagccaataaacgagtcagcaaaacccagctttggtaattaaataccaattgcagtcccaagctccaaggtcacttacctttaatgtaagagttcctgtttagtgagattattttttaaaagactcaattagctgtaggttactaacactttgaagaccccatcctaggttttttgatgtcttattcttccctacatgaccagtgtccttcaatagtttctctgttaggcagacctccaccaagtggctctatccagaacaatctcccacttgcaatgtcccagagggctaattatcaccaatagtactgttgtgactatagaaagacctgtggctgcagaaagacccaggcttagtaattaaaaaccatctgttcggcatccatttgtttggcactcatctcccaaatttagagcccttagcaccctttccttcattctatcttgcaccccagttgacatgctccctctctgatccagcaatgggattggacacatctttgatttcactcctacttggccatctcctcagcaacagctgccttctcagcttgacttcaatctccatatttgctatggataaatccataaactgaatgcatctgtctctagcagctggaaattatgatctcccactatgtgattcccttcttgcatgggagtttgcatgagaaacagcttaaaaattatttgtattgcagaattaaccctttttttcaatacctcccatcaaaattcttctctcactgtggtatttggagggtaccagttgaatgcacttgaatgtaagaattcatactaaagtataaatgactactaggtggttaatcagatttatggctccctgaaagaattatttcagaggaaagcagcttcattctgaactgagacatgagaagacactttgccaaattctcagtctctacaggatctgccccaacacatacctggtctcctgatattatttttatttgctttcttcttccacataatgcctgcttttccaaggactgagatcataaccctcagtataaccacactctttcactgccttcagggtgaagcctacatttttacttggggcccaaacatagaaattcagtctccctagttgccacccctctgatattcctaacttatcaatgcattagatctttgggaagtgtgatgaggtggactctcttcctctccaacaagcaaacactgcccgattcacattgtcagtgtttgttcatagaaccatgccatttgctcataaatatcaaacttcatgggaaatgtttttcatgggccattttccctttctgcataaactcattattaaagaatataaagaatagttgtttatgctcttttattggtgatcaaggtaattatgataattacaatattttgaacatatctcatttaattatcatcttaaaccctcaagatagtaattatttgccctatatcatggttaaagaaattgaggtttggacatattaaataatttgcctaaagtcatgtagtcagcctgtggttgttctagggttcagatgaaagtctgttccaaattctaatttcaaattctgtgttccttccactgaatctatatggctaaggatgatctcttgtagtgaaatttttctcccctcaaagttgaaggccattttagtgactaatgggaacttttctcttcattcctagtactcctcaagtttataaagtaaggaccttcgggactggcacgacctcattatggctaaccagctagctcccctcagcactgttttttcctgctggtcaccaacacccagtaaatagttgctgattgatctgctgagatacagaaagatggaccagaccaaagcaaatgactttgtaactgatgaggagtgggcagagatgtaccagaaaggtggatgaggctgttggtgcatgtggccagaaatgaaataaagggctgagctgggagataatgaatagactccgttctactgaaagtccagaagtggtaagtcatattgcatgtttaaaatggtaagattcaagagtggtttctttccagacaagaaatgttcaaaccattcaggttttaagtggatccatttactaagttggcctgcttctagcattatatttatccattctgctattattcatttgacaaacactgactgagcaccaaatcagatggaagaaccttctcccatttccttggccttatttctgtcctaggccctcggccacttggttatggagagttctggctcttactagtactgccacggcagcagctgccatgactatctctggggaacacccactttctcagtcttccctggcgagtgctcagctccgacactatgtccatcataccctttgcggtagaagccacacaaacctggaactcaggctcaacttaacaaaattcataagcctcctcttcctcttaccactttgcaacttaaataaagcattctaggctgggcacggtggctcacacctataatcccaggacttggggaggccacggtggggggatcatttgaggtcaggagttcgagaccagcctggccaatgtggtgaaaccccatctctactaaaaataccaaaattagctgggtgtggtggcacatgcctataatcccagctacttgggaggctgggacaggagaatcccttgaacctgggagatggaggttgcggtgacccaagattgtgccactgcactctagcctgggcaacagagggagagactgccttcaaaaatagtaacaataataaagcattctaacacagggtctgccatctggcttccctagtggcttccctgaagtacggggattgagagtaccaggggctgggtaggtaccttcctactggagaactttgatcaatgagagaaaagaggatataaactcctttcttttgttttctccaatccaccattctaaggtgcagggactctgtttagctcatctgaacatatcctttatagctgagcaacagactgtgtctcttgggaagctacagccagcttggtaattgacagccctgactatgaccttatatttgtgtctcctttttccttatttcactttttttcccctctcagccttgttgcccagagattgtacctcccaacaaataattaattatcactaaggtttgccttggcacatccctttggcggctttgccagcagacgcaagcaggtaatgtgaaccagacaccgtgctaggtgtgggacatcaaatggtgaacaagacagatttttgcccgacccttatgcagttttcgacctagtgagagagacaggccatatgctattaaacaacaataaacagaaaaaaaagcacaatttgtgatgagttccataatgaaataaaatttacttctgggaggacatagtggtggaggggttggagaaaatcagtttaaatatggagaattgaagaggtctctgtgaggagtttatacttaagttgaggcatgagccagccatgataacagcagagggaagagaactctcagctgctagagtatacagcacatagcaaagccccaaagcaagaatggggtttgagtgtttggggcacttgtggaagataaggatgattgcagtgtcgtgatcaaagcaaagagtggctgacttgaggttggggaagatgcaagagtcagatcctgcagactttgtaggctattgaatcaggctgaattttattttaagtgccactggaagccaccaaaatactttaagcagagatattacaatagaatccggtggaatgagtctccttaatttattagcataatgccttttacttataaccttaataataaaagaacacaaggattatggctgtaaatacatggaagtaaagtttataacatattttatgtgttaacacaagcacaaatatatatatgtacatgtaccgttaggtacatatactctgtatacgtaagcatgtatatactacatatatacatgaattatatgtgcttatgtatatatagtatatgtacatatatagtgtatatatacatgcttatatatacatatatgtgtatatatacatgcttgtaaccaccactctctcctaaggaatcataatttattatactactaattttatttttttgtccagttagtccagcagtgtttgcttctttggccgctttgctcatgtccattcatgttggtttatttccgtgtattaatttcagaaagtttacagtatttgtggccgcaatttcttgaagtacagagcttcttctttctcaattagagtttcttcattaactgtagttctgttgctatggctgtcattagtgtaatctgctaattcagaaattcacggaagtacggaaatacattttgctaatgtgcattgcaaaaggccctctaaaaaaatgcctcctatataatgtgattttcaaaatgccagctgcagctgccagggaagagcttttatagaccaacctggatttgggtgagagcaatatgtcttctaggcagagaaagctctcctctaccactctataaaggcttttctcgatggttgctacctgtctttgaccctcagatgtttccaaattgcctctctggaggcagctttttagccagctcacttctatttaagcgtgttgtgttaaagagctggcaagattttttagaagagtttcaccaaacaccaattcctgtgaaaatttaaactatatattgatatcacccttgcgcagatcacaccgttgcaggcttggcagtaaacccacatgctatgttttggggagtaacggaattgttaaattaccaaatgtattattttctggccagaaattgcaccatggagattcatcccttttctttggttggaaagctttgtcaattcaggggatcagttagtaatcatttagcatggaatagttcacaaagttgattttcagaagacaattgcctgagatgaaatgggatatggaatagattctgacagaagaggatagacactgtcaggaaacacagcgctaccagggaggtctataaacagagaaccccagggaatgctgggtgcccaggagagatggctgcatcggtgctgaaagcaaagatggttgtgcgccaaattttaacttcagacttttgcctcaggcagcactgttagcacttcaagtcccattaaggaccctctctttagagcagatggtggcttcagtgataacaaagaaaacaacagtggtaggagaaaagatggccagactgagcttcaaagaagcaaaacaccaagggaaaagttattcatgtttcttgtggggaatgaatcactgaaaaaaagtctttaaatggagatgatagaatggaaataatttatttacgagagtcagtattatcatgttcatgataaccttggctcttttcagactttctgcctccgtgtagattggtgaagaaacagagatgtatctgatttgaaacaaaatataagtgttccagattagaacatatttttatattgagtatattctgtgcccaactgggataatttacgtggaggtttgagaaggtctttgtgaggagaggatatttaagttcagcaataaaactaagtaatcaaaataatattttgccttccagtaagaaactttcattccatcagaaaccacgatgtctttggtttagctaattttcagaattaagctaattttgatattgcatatttaagaaaacctaaatttatagaaattaagtcaacagataaaatgaaaattacttgttgcttatatataccatgtgactttatgcatgcagggaagtgtatgtctatacatatgctcacatccatatgtatggacctgattaaagtatgaccttgttgtatatgtgtgtatgtgtgtctctgtatatacacacacacacatatgatcatttggtgccaacaaggtctacttatttcaggtgatctcttatcactggctctgtactccaaatttcacctgtgaatgtggacaagtttaaattagtcaaatttccaagatttcttgtcattcgtgccacatgttggctgttttgactccttctgatttttgaccctctttattgtcttaaccttgctttcatacaaggaactcctcaactcttatttcatatgcatctggcttccatttcatttgtggtttctgggcactacctagccctttatgttgtttgtcaaacatgtctacaccttcctgatcctggctgctcacactgtctccaagaattatcctgaggtgagcacatggaactttctaccttcaggctggtttaataggaatctaaagttaggaaaatgtttggccttttatccctttatttgtggcatctaatagcattctattacctaccatatactgatgacctaatcagatttgctgtgctgattttcatgtatgcaaagattaataaaccatagtgtctaatccccaagggcttagctgcaaatgtagtaggtgagagagacacataaataagtaatttcaacataatacaataagtattgggatagatgttgacacgaagagaggaagcataaagaaaagggaataatgaacttgacttataagtaagggataatacatatcagtttgcccagaaaagtcctaggttatgaccttgcctcagaatctattagagtaagcattagtctcacacttttcactttccaaggtgtcccagttgagaccaaaaaaaaaaaaaaaaaaaaaaaaaaaaaaaaaacatggtgaccctgcttgtattagtcagtgttctccagagagacacaaccaatagggtagatacagatagagatatatgttataaatatatagatatttagatatatagatataacatatataaccatgctaccagcttcagggaagctggtagcacggttccgatctgaaggtctaagaaccaagagggggcactggtgcaagcacccaaatctgagggccgtgggtgtcccagctccagaagagaaaaagtaaattcagctttcctctgcctttttgttctgtcaaggccctcagccaagcagatggtgtccacccacactgggtgagggtggatattgcttaccctgattcagataccagtctcttctggaaacactttcacagacatacccaaaagtaattctttaccagctatctgggtatcccttactaagtcagtcaagttgacacctaaataaaccatcatactatttatagtgaaaaggtcaacgtttgtaagagaatgcaagaaatatgataaaaagtatcagaagaactttgccaatctagtgagacagaagtggaaattactggtggaagaaataggcccagtgacctgagcaatgcgttgatctggagaacgacctatcgttcacgtgactacgtgactgtgcctcgtaggagagggatgagatgctgtgggctgaagaagaaaccaggagccaacaatggtgagctgtctctctctgtaatgtcaagaaccttaactttttcttgtagacaatggaatcacattaaaggttttttttgttttttgttttttttggtttttttgagatggagtttcactctttttgcccaggctggagtgctgcagcctcagcctcccaagtagctgggattataggtgcctgcaaccacacctggctaattttttgtatttttagtagagatggggtttcaccatgttggccaggatggtctcgatctcttgaactcgtgatcggtctgccttggcctcccaaagtgctgggattacaggcataagccaccgtgcccggcccacattaaagtttttaactgaaaatatgacctaattagatttgtactttagtatttctatgtggtatacatagaaataatgtacagaatagatgagtagggaataaaatattaggcagacagaacaactggatcataataatccaaacaagagatgatgggggcctaagctaaggcagaagcagtgaggacacagaataagggatggagctttaaaatagccattaagaaattgataaaagaatgagagtcaagatcatactcagttaggttcatacaagtcaggagctcagaaaagaagtgtgggccgcaagtatagatatgagaatgtgagtgagtgaaaaagaaaggtctgaaattcaaagacaaaaagatcaaagccagagcctgcccttctaatttaatcagaacaatgtaagaatataggataacaaatggcaaagttttaggaaaaaattgtgtaaaagattcataggaccaattcattttggttaaataattatgacgaatgttggcgctagagctttgtctgcataatttttgttatttattgtatatcttattctttttgaatgtggtatctctgaactcctattatgtaatgaggattttttaaatagacaaaacagaaaatcttcccccacccatgaagggtccatttttgaatgatcactatgtataatttaagctattggttaaggtccaagtcatattatatgaatcagtagtaagatatatttatgacagtgtataattctaatactgcttgtatttgggcaaaagtaaaatgccctgcttgaaaagaatcctgcagttgctacaatcatgtaaaaaaaaatagttgaagtatttttctcagttgatgagtgtagatctctagacatgaaatggtattaaaccttctgggaactttagatgaagctttcagagtgacatttctaaatttgaccaatttttaagtaaaggtaaaaatgtccaacaaaagagaaattattgatattatattcattttctatattataatttctgtttttttctactgatctataagttaattctgaagatagttttatgtaataaaatttgctcaaattatgatacataaacttccatctaagtataaagtcgtacataaagctcagatttttctaaacatgtgttgtaatatgttcaagtagctagacccaatacagataaattgtttattgtctctgagaatactttctaaagtactacttgaagactcaaatgttttttaatgttctcaaggcagtattttctttcatatcaataatttacaccatagtaaggttttttctttcagactatgcaaatgaggaatatgaactaattcagacaatatttacacaaaataaatgagtttaaaacatttgatttactttttaattttcaaggtggtattcaccaagaagatggaattgggttaagagcaataaaattgatagtttcctttttttgaaatcaaagaattaggtaataacaaaatgtttcaaatgctttcagcttctgttcttaacagttaattttaagaacatgtctatttatcatgttacataaagttaatgttttataatatcttgtgttttaaatttatttattgatatccatttatatatcttagtataatataaacacactgagcaaagatattttcaaaaagcagtctgaaattcagtaatttaattaagattagctccctccttcctactgtattttttataattaagtaagtctttccatgtcatgtaatctttgagcaatggcttttgtttgttatgggtggatgctatagcgtgccacccagatcccccactctaccctagaattgacttttaccccagtctctgggagggatgggtgctgagactgacaactcaatctctctctgggaattgccttttgctgaaaaaagctgcctcatccaagcttgtccccttcttctcaggatgcagcctccatctaaagcctggtcatggagtggtacaaaagttctgtccccttgcctcagtgtgagacatctctgtatggccatcctagcttcaaagctttctctggaatcaactgatgacttgattgaggctgcatcacagttccagtcttgcttcctttaccttcctacaggtgttgctcctaaaagtatttcccaataagtcatctagatgaaaactgcagcatctcagagtctgtttccctgggaaactgacatatggtgccagcaatagttgaaggaaccaggttataacagagtttttgaacaggttcccatcattgatggtagatgggtgcaatggaataaaccgtgttcccccaaattcatgtacggaagctataacgtcaatgtgattgtttttggagataggatttttaggaggtaattaaggttaaatgaggtcctaggaggaagattcatattctctctctttctctctgctttgtgagggcacagtgagaaggcgaccatctgaaagtcagaattagagccttcaccagaacccaaccatgctggcaccacaatttcagacttctagtctccaaaattgtgggaaaataaatttttcttcttgaagccacccagtctacggtagtttgttgtggcagccccagcagagtaaggcgggggttattgaaaaccctaccatgcagtagaggtgcaattgttataacttttacaggtggtgaattcagatgggattctggtgaaagagaatacacttgtcagtgaaatatctcaagtgtttgaatagttctggggaaatggtaactataaagaaagattacagaatcagcgttttctaaggactattgatgcattgacaaaaacaataacatttaagggtaattaacaaccaattcaaggtaaagtatgaaagccagagggcctccttgacagcatatgacaagacactcacacagctagaagcagacaatgcagagggttaggtatgaaattgtattgaaagaatagcagaggtacaaaaaagactgacttctcaatcccagcaagtctgctactctgaggtcagaaccctgcttagcaaagagtaggatcttgagatttgagaggggaatctggatcagtgaatttgaaaaccttgaatttctagattatcctctaccctctgcgaagtggcccgttcttccctgtaatagctatctttttccccttgtttgaagatgaagaagaagtctcagtcttgtaggacaatacacacttgtctcaggatctagctccacttttccattggcaccaaaacagtaattacttttataccacaacataatgcaaccatgaaagtgctaagcctgatgaagaaaatagaccataccacaaaataactgcaggtccaagtcaaaatgtagctgagatagtaactagaattcttagcattctgatatcaagggtaatggacatgaagttggacaatgaagagtttatttctgtgatacagtttttaacaccctggcaatgatcctgatataaacttagagaaagcaaaggttcacactgaatgaagtagagccaccagaactgccatgagacagcagaggaaagagttaagaggctgatggtagtagacttggtgagagaatacactgaataaggccaccaaacactccatgtgattctgttccatgggacggcccagggtaaaaaaaaaatgaccctctccaaaacataaggactgctcacatcatctgaagccctgaaggccaggccagagctgaacataagagatgctgctacaaccaagcaccctgagagcaatgcagatgatagaatcccagaatgatagaggccaagtggctgttcaaaacaggcacagtagtaatgacagcatggccagcgtgggtagtgtatgttgcctgagctacataaaaacatggagatacttgatagaacccaggaggaggataggtgggcaactatcaaagatactgctcaatctatttgatgaaaatatcaggagactattggaaaccagccagtagaaagtcatgatcccttttccagtttcctgaattacattagtatttcagcttcagaactcacatactgaaggagatgccaagtccctgggaaggccctacaactccactagtatataaagatgctccagtttcccacctaaaatagtttcagccatattcttagtaaccatatactagaaaaaagggtatacccagacatttcaagtagtacggacacagaatctaagttgatattagtacctggggacagtagttgtcatcacggccctgcataagcatgggaattggaaagccaagtaataaatgaagtcctgacccacatctggctcgcagaggtcactagattcagagatccagcccctgatcattttcctggaccctaatatataattggaatgcatatactcagtagttagttagaagaatcttcacaatgatttcttgacctgaggtgcaataaccatcatagtgggaaagactatgagaaagcttcttaaggtgcccttccattccagccaacagaaggaaataaaaaaataatattgcatccttggtggagtggcagagattagtgctattcttaaagatacgcagtatacaaaaacagtagtaatacaaaaacatttaattcatcagcctcactgctgcaaaattcaaaagtgacaatggagcatttaacactcaaccaagtggtagctccaaatgtagctgctttgtcagatgttatgtcttcataagcacataaccacacagccctgggaacatgatatgcagccactgggctggtttgtgtgttcattttcaactctattaggaaggaggattagaagcaatttgtctttacatgaaatagacaaatgtgtgcatatatagtctctccccagagctgtgttaactctcccaccctccataattatatagttaaagggacgagtactaactggacattctgtagaatatcactttcacccactatctcaaagccataatattaataaaaccagactagcaggaagcagcaagaattttaggtgttttgttaagccacatacacatacactccaggtgaaagacaaactttataaagattccaggaccaaccgtatcagtaaagttttaggcatcagtggggtatgtaggagcatgcccttgaagtacaggactgtccttgtacttctcacccctaaggaggaaacacagtgcctggtaggtctctttgcatttaggaagcagtgtattcctgtacccacattggagtcaactcattctgagtaggagtatgatttgttaaatgaacaatttgtttttttagttttaagggcatttaatcagaagttagggtttgggaaactaactcaggtgtattaattgtttaagtagaaatacagtttaatttttgctttgaagttggttcttcttaatttttttaacctaattactaatcctcacaaagatctttccaacaacaagttcagtaggtttgggtaacagtaagttgctactggcttctgactcactgaatgatggtgggattgcagtttcatcttctttataaactcgctcttcactggcaagtttaaatgacttggaaggctgtcagctttgagtaggacctagcaggaaatctctgtagccgttctaggccgcaatgcaagtggccctgctgcttgggtcttaaggcctggcagaccctatgttattatacagagtatatggtatggtaacagagataactgtggtggaaaagatcctgtatgaagtatatggcaaaccacagtaaaagcaccacagtgtaggtacatatgtttctggaacaaagataatgccatctgcaccagaaaattatgccaaagaccatggtgtgctactaccctggtagcatgatggtaggacatgaaatgattttgtgaccagaacttcccaccatggttttggtcctgtcagatgcatcaagtcatatgatgagacaagcctaacagcaatctcttgaagtggtgcatctgaaatagagtctaggtcatcagatactctggtgcttgcacaactgactcatgaacaaagtagttacggtggcagggaaggagtctttaacactacagactctcactgatcaaagctgatttaactactgctgctgttgaatagccaacctgccagcgatagaaacccacactgagcctctaatgtggcaacatttcaggaaggaccgaccagcctctccatggcaagttgattatattggactctttccactttagaagaaacagcaatttatcttgactgaaatcaatacattctgaatatgggtatgattttctttctcccagggcctccatcagccccattatctggggcacatttgatccacaaacacaggatcatatatcacatcagaccaagcagcccactttatagcacagaagggactactatgaacatatgaccatggatccactaatcataacagttacagcactgcccagtagctgctggtctgctggaccacagggatagcattttcaaacagcagctgatgtgccagcttggagagggtgctgtaaggagaggggctccatcctatagtatacaatgtacactcacatataatgaccgttacatggtattatgtccccagtagggagaataccaagacttgggaagaaaagtgatattgggattgcccctgattatctccacagacccatttggataatttatgctttctgtctctgaaactgtgtgtgtcaaagacccataagttctgaacctcagagagggaatgcttccaccggaggacacagcaagagtatcactaactgaattctgactgctacctggttactttgagctcttgaatgtgggatgtcccttagatggggtgtgtcctaagatgaggtagctttctttgactgaggtcaatgccgagggaggaacctcggctatgagccttcagcagccatgactcctggcatctgaggaaatgagtgtcttcatcttgaagaggggattggccaacaaccacagcatccactacagtccattccttgcactgctgggcagcgtacggcttttatggacatttcaccccatctgagaacagctttctcaggattctggtaagtttctcttcctcgcaaaattataggaaatcagtgacacaatttataattcccaacactggagctggtcttagggacacaatggatggtcatcattttatccatctgttgtagccacactaccactcaacttctcctctgcctcatctccttacagctatcgttgctgtgagcaagccctagtgggcatgcaactctccaccacggagccttatttccaaggactctgcccttcatatctcaatttcccctttcctcagagggacattaaatattttgcaataaatacagtgcttacaaacagccttacagagagtatattgacctgcaaacataatatcatctgctcacctatgacaattttcagcttgtaaggcaggtatctttctctaaaacttacctggaaaactggtagagaatcccccctaagagttttaattttgaggggacacaagtgcaaaaaagcagttacacttgctatattaattagtttgcaagggctgctataaccagcaccacaagctgaatggcttaaacaaaagaaatgtacctctcatggatctagaggctggaagttcaagattaaggcattggcaggtaagttccttctgagggccgagagggagaatctgttctaggctgttcctctcacctaacttctagtgatttgctggcaatttttggtgttccctggcttatggggcattaccccaatctcttcctttgtcttcacatagcattctccctgtgtgagtgtctctggtccaaatttccctttttataaggacaccaatcatgccggattaggagcctaccctattctaccatgacctcatcttaatttaacgaattatatatgttatgaccctatttccaaaataagattacattttgagatactggggattaggacctcagcatagcataggaattcttgtgagacacaattcaacccatggaactgaactttggggaaaagattgcatttctttgggaaattaagtgggagaaaatacaaactgtagaagtaataggcctgggactcttttcacgtggaaaatttagatcatgattccccaagaaaaatgacttgctgtccacttgctgtttggggcatctcctgcatggctgactttcagatgaggcagcagaaagcactagactccatttgtatcctgacttgtacctgtctctttgctccatctgaaaactttatggtagaaaaagaatcaagtgtcttctctgcatgagtccctagtaactggttacagctaatcttctggagaaggagaattcaatctagccattagaattatgggcacaacttctggaagatgaaaaccctcatcatcctgtttggttcactgaacctgaaaggcccacatgccatctctcatggccaaatcgaacatctgcatttcggttggtacatgcctttggagttggcactggccctgtgaccacagtgcattctattgcagctgttctagtggcttggctctttttttatccccttaggtcttctggtggagcaagaggacacccatggtggaagccaagagagtcatcttaatgaatggcatattacagcccttgtgaatgggacttgcattgttccatagcatagctggccaaattcctgtgattgacgggtcaagttaaatcaggcataaaagtgatgtggagtcttttctttcaggaaacctgtcacaaaagcactcttgtcccaaccaaggctcctttttgtatgcactcttagagaaaagttaaattttatatatgaatgtggagcatgtcctgtgtaggaggactctggaactaaagttagtcagacttacaaagtaaaaagctgtcccatgcccttacgtgtaccattcatgcggtggatctgggtgcacagacccctgactataaaacctgggtcaacgcctccagctgtggcctctcctctgacaaccaactcattaaacgcaggattcaggaacctggtagaacttggccacaactgcaaaaaacatatttcagtcccgaagtgtcagagtcgggggcagaggagggaggatgaaccaaacgctaaagcaaataaaaacatcttttaaaatgttgtctgcttgctgccaaatgggagctcagagggagtgccaccaggagcagttccacatggcgaggccttccgtggagaagcctggctggcaggctgggaggattcagtaattaacactgtcaaagcctcatgaggccccatttcagcagctcgatttggaaccggctgcccgagtacagtcacccttcagcggcacagctggggtgtggagtccatcagcagctggtgcatgtgtggcttaaactttgctgtgaggtagaaggaaatccgtggggattcttttgggtgctttaaccctgtggggatgggggctcacagtatctgatttttgaatagtcaattaaatgaggggctttaagaagctggagcagcccactcctggaaataatagcactgagatggctccataacaagatcagagccagagagccacacaaggatacttcaggctatagccccgtacttatggaacaggctgttgtgggctggaaggagggctgaggaaacattgggaaggatagataaagttacaacctatgaaatagactctgaaacagggtatggtaaggtagagtgatggccatctcttaaaaaaattagtgaataggagctgtgctgtaatggaagaaatgtaaactgggtttatggtttcaattcccaagaccaatactcttagcactgtgaagttagacaagttgctcaaccttttttaactcatttctttatatacataaaatcaggattatgatagctcatatggaatgtttatcatgaatatatatgtagaccgatactatctagtaaagaagctataaatatatgaatatatacacgtatgtatagttttgtgtatatctgtcatttattgatcaactactatgcactcaacaaacatttactgagtacctcctatgagcaggcaagtcttgatctataacaagtgagattcctcttctcttggggcatacattctagtaaatgaagaaaagaaaacagacaactgaacatgtaaataaataatatattttcagattgtggggagacctatcctcagcatttaaaaggatggtatgatgaagaactgataagactgctttaggtagaacagtcccaggatatttaaataattttcctcatgcaattttgctgatatccctgttgtggtaggcactactgttaccattcgccaacagagaaactgaagttctataggttagctctaacagagcaggtttaaaaatgtggatattcaatcagaattgagtgagctacactgaatacaacctctttagtacatggacatctaaaatcaatggatgtttccagcccacattcgcttttcttttgtaggtaaaatattgtttgctagaacctatatgtattatatattttgaatgaacgacatccactgagaattttggaatataggttacctatcattaagcattggaaaagacatgaaaggacctaagaccattacactgctaggttacagaccaggttcccgtcacaggcatttcaagcaatcttaggagactgtttcacaataaaccaagactcctctcaagagattaagacagttgagtggaacggcttcgaacaaatatctttgaattgggaaagatcgcatcttcggttttattcttttcatgtttcttactaaagcctttattacttgtcacgttgtaaatggtttaagtaaagggcagatacctaaacttgcatcgtggggaaaatattgcaacggggaggaggaaattaaatcatatacatctttgtcaaaacatgtttttagctagatttgaagcatcagtatcttttttttattatgccaagttttaaaattatgtgaaacgtatgtctcccttggacccacaggaaggacccagctaatgaagggtaaaatggtgctaatgagaagctaaaaccatagaggtgagagccaggattcaagctcacatctccacaatcattgttctttccagattactatattgctttctgcataaagaatcatgtaaatttgccaaacatcgcatcaggcacagggtagacaacaataaatgctgacgtctgtatatggctgaggaaatgaacgaacaaatggatgatggcacagatcccctccaccactgcttctctctcttatgtttcacgctctcttcttactacttcccagtgaagcccctaggttccaggcaccctaattctttggttgcccctgcctaacttttgctaaccttaaatgtcttgccttgtctcgtgttattttctcactcctttctcatcagccctctttctcaccccctgagtgtgcaaacgccttcccagcttcacctctcaaaaggctcccagacttagtaaatactatcagtcttgtctaagatttggcccagatttctctgacaccactgagtcccaagcacttaatttccaccctttgttgtctcactcaacctttaaaacaacccatatgtggtacggttctcattgtacactgaagaaaactgaagcccagagcatttaccagcttctccaaagttgccctgctggtaagtagtggagtgataaataaacctatgtcctctgtcctgatttgctggccaaaagcatgacaatggatcaacattggttctatttacccttccttccttagtggtgagtagtcaatagggtgacagtatgtagggaaggaaaataactgtgaaagatccttccgaatcaccccgtgcagaaccaagtagttgagtactggggagtggtaactaacatgttgggaagtagcattttggaaaaactttaatggtgagctttgtcacacactacatttcctagatctgctctgttaagcagctaattaattctcttggggcaattacccacctaccagaaatggtctgctgcaggcccatgcccctaggcacagtctgtgttaaataaacagcagaagaaccctgaagtggcagggttgtagccactccttcctcaggtcagcacttggaacacttgcttgctctgggccgggctgcacagcatcatgcacaggtgggtgttctgtaagtgctttttaatgatggtggtagtggtgatgcatgaaggtctgtttatacttgcagagagggtcgtgtattttaacaaggaggacttttgattggcatttcaaagaggccagtgttgttggaaaatgtcagcaccctgcgtaggagggcacttcataagtgttgagggattgggcctgctaggggattaggataattgttttggagtgaatgggcaggctcagtaaaggtgacctgaagtcattttaatgggcatcatggaactcatggtgacaactcagactagtggattaagatactctgatggaaattcccaatcactgcttagcactggttccgctgggatactggatgcctattgtattgctgtgcctggtagggtgactcagttgctgggctctagtaaagaaatgctgatcaaaggaactgccaccccaccatgtggcacagggctcctttgcctccaaagatgaaaggtgcctatttccatggcacttattattcagggagagtcttttaatgcatgccagttaaagatcaatcagggatgaagtcaaacagtctcagaatagaaagtcctatggatgaaagcaaagaagggaaactttctcctgagtaagcaccaggcctgcttgctgaaagttagtattacatctagtttgcaggctttaggaataaaagataagcgtcagaatgaatgcacaggtagattctgagtttaaaaaaatagtggtttatattatgtactagtagtccacgtctacctgcaatcctttatatatgatagaaatgttgggtaaaaaacttaaatttcaagtactggttgacccagcccaaaattattgaatcgggtcctttttttggccaaaggctgggatgctatcattgcccttcatgtttggatacttttgctttatgcaacttgaatttctttgtgcatgagactatccaatggccgtgagtatcacaaccaccctaaaagaactaaaagaaggtattctcgaaacaaaaactggctttctctgcaactttatttcatcatgaatatatgaagataattactgattggtgatttcaaagtttatagtgctgtcagctggcatgggggctttaaacaataatgctctgaacagttatagtttatctaaatcagatgctcattaaggaattggctagagtggacaaggagggaagcatagggcaggcagggcaacacatcagcttaggagctatggaatgtccagctttgctgcattgcgagatttgctcccgcagcaaacaaacaaactttgggttcctatagaatacaaattgaggaactgtatacacaagtagcactcagtctggaaattccatgccttcccacattggtttttgtaaacagagtcttaacacccacattacatacctggcctgggctgcctataatcattccagttcttttggtgagtagacaataactgtttcagatactagactcttttaagtttaatgcttatatgctgtatttatggagcataactggtccaagatagctcttctttaaattaaaaaatgcataatatgtaataaaatttactgtttctctatgcaacatgctctttctctacacacattcatctttgaaattcctcactcaggattctcaaagggccaaggagagtaatgaagatcttgatgaaatagcccaaaactttgaaatattctttctctagaacagtatcagaaccactgtgggtggttgttaaaaattgaaattcctggaattcaacccaggtctactaaatcaaaatcttgtgctgcttcaggaatcttccattcatataagtctcacaagcacttttgtgaacctctgccagatgccaccaacttgttttcagggacgacgctacacctattctagtgttttgggtgagtaattctcatgcttatagagaaattcatctaagtttgcttacctacatttttatctgattctagggagatggattagtgtccaaataatttatctaaaacagaaacaaggatttaaacaaaaatcttcttcctggtcctttctgctcctccctctcctccttttcactcttcttcttttctcttcttttaaaactttcctggcctcagttacaaacatatgtgtcatactgaggaagatagagggtaaaatgccagataacaataaaatgtcaaggtgagccaacctcgtttttgggattcatgtagaaagtctgaggggggaaaatttatttacaggtgggttctccagaggaagaatggcacactgcaaggctcttagggagagcataggagagctggaaaggtgaatgctgaagaataaaataaagacataatttatgaaagaggacaaacggtagtaaactgaagataccgagggatgtaaattttacacagaatacaacccagcgtcactatgctggtgaatgttgtgtgaggaagaaaagagtttaaagaaatttatttgacgtctagctgagccagagaagcgactactcacctacttattaccaaaaatatggaattacaaagttttagccaatatacctccattgcgactatcttcaagtcctaaaagtcacaggaaacacacccggataactgtctcactctcataaaaatccacattggctgggcatggtggctcacgcctgtaatcccaacactttgggaggccgaggtgggcagattgcttgagttcagaagctggagaccagcctggacaacacagtgaaacctcatctctactaaaaatacaaaaaactatcgaggcatggtgacgggcacctggcaaagcatggtatgatttggcgatccataggcctcttctggtcttatatgattccctaatccagctacagagcttttattcatttttagcaagaaaaccattcccctggcttaagaccgaatgctttaaaaagtccaaaatcacaaggcacaaaaacccactttacaaccaggtgctcggtgaaagtagctagaaaatcacggcccagggaggttgggctggagagacacggatggacagatgtggttgtgaactgtctgaggctggaagccctggcatcgtgtcccagagttggagaggggctgcaatcaggaagagcattaccagacagtaaaggaaactaaagggcagcatcgagtgaggaaacttcaaagacaacattttcttgcttcataataattctcaaggctgggtctgatgatgacattagtggaatgagtaaaataggtggaaaacctgaggcagggagaagttggatacttctttaatatgatgcatggacatagccaatattaagagacagactgtgtgtcaggcagtcatttaaccttcaggcagctattattttctctaaattaaaccaacactgagggattatttaggggaaaggatagactgattttccaatttgtcaaaggctaaagaaaaatataatcaacttcattctcctgtcaatgagagaacaatattcatgtactctttttctttggcaggattagttctaatcattcatgtctgtgagaactgaatttcctggagaaagccattgggaaggttgaacttagagttacatgttttcaaactgatcataaaatctttttctaagtggaaaataggttaaataatgtggtcttatcttcttacctatcctgtccctccagtttctggcttctggttgtgtagcaaggactttagggttgggggagcaaaatagttataaaatgttgagccctacaaatggtagatttggcttctgtgatcctgctaattgggtaggttcctgccttctccctcacccatacatccccacgggcttcactgcgtgcatggagacaagctgagggattgattgtaaagtaatgggatcaatgctcacaaacttgtgtgaatatcagccttatttagttctgggattcagttttgtcagtgtgctttggtgtgagattgggaagtaaacaaggcctttggtgaaaaggaaagagtgtattatatccacatggattcaaatttgtattaaaaaacacaaaccctgggtagtccagcaaacaaaaataataaaagcccaaatacaaaactgcaggtcagagcctttgggatgccagtttatgtcttctgttttaaagtcatatttcatatttataaatgctgttccaaactcaaactgtaaagcaggtttggatttggggatattttgggtcatctacctttcttgcagtactctatcattaaactagtaattgaaaggcaagtaaacaggagccatgcatttctttgacttttaaaatggagtatacatgaacatcaaatattgaaatttatctaagtatatatactattttactgatttgattatgtatagctgaaatgtttcttaacatattattctaagatggtactagcaaaaggaaatgattttcaaaaatgttctgaggagcacaagaatgaaaacaaaatgataccacactattgggaagcagagtctgtgtaatattattgttgttactgttaataataatatttcctaatctgtagcaacattaactagtatatagtaagagcttaactcatgttgaattaaaaaatcaaagttctataatactccatcttctacagcgtcttatattttgaagtcctgggtagaaatgtcagcataatcaataactaacctgccagcatagcagtgtaacagaaatctgtatcttaagacataaagaaaaatacctctactccccaggtctcatagatagaaaatgagccggtgattttgtaatctgctcatgtctcattgaagtaatgcattgtagaactgaagcatctactaagaggacgaatgtgcagtgaattcaaaccagttaaaccttaatagtgtaaatgaaacctttaaattgtgtgaaccactagcagccttgcaactctttacatgtgcaaaaaattgaatgaacacatatggtcaccatcaacttggttatttaattctgagatgacacacgtattgatctaactgaaaaggggaagctactatatagctggttgtaattagcccaccacaaatttctataactacttcagtctaaaccaaaagccaaaatggcatttcatgattacaccgtcccacccagatttgcatttcttgatgaattcccaaggttaggatatgagccatactgtaaaaccaaccctcaattacacctttttagaggggaagattagtggcaggtggtgcctgctataaaagcctcattaaaacaccttctggtggagtttcacaaaaggaagccaccagatggagacccatctccacatggcagtcttacctcaaatgagagtttcacctgacactttggggacagacaattttttctcacctaacaagccactgaggttcaaaagacgatctattaggattaatcgtacttgatcactaatccattgtaatgccatatgctgaaagccttgttcactgttaagcctggagccaggtagagcccctctggtaatgtaaaccctcccgttttcctgcagctaatctaatttcacctcctcccagacctcgcatgccaggaatgatgcttaactcttcctccactgcctctgatgcgtttttgaatggtagcaaatctgatctcaaaggtaatgacgctgaaacctgctgactaattggaaaatgattttcctggtggtggtgtttagtggggcgaatggataaaaggtattcattctattgtgcacaaattcaaagacttagccctggccttcttatctgcacagcttgatattactcatctcctcctcttccctccttctctaaatatgtgttcgttgaatctgaatttgaacaatcagccagctgggcagcaagagtgaaatttatgcctcatagaggaaattccatcaccttatgcagtccttgaaatggcaagtattttctccagtggtttgcctttggtataggtccaaaccattaagtgccaaacagcttaactcaccacatacacgcgtgcacatacacatatatagttttcttatgtgttttgtgttatgctacttacaaagcaccacccacaatgcactttcttgctcaaggccccatatttctgagttgcgcacataatcatacatacaggtgatatgagccccacacattttgctctatccgtgatctccaatatgaggagttaaatggaataactttcaaattccatgcaatattttatgatcacttggttccagccctaaacagactgctggagggaatagagaaaatattccatctgcaatgtacactaaacaatgtcatcaagatgacaagagtcgtcctaaagtcataccatgcattaagcaaatgaggccaggcccccagtgcataccaaatgctgtgcttcacaccttcctaaaaagtgctcccccaaatgccatgctatttaaagcattactgtaattgaaagatctaatcaatgtttcaaacatgtgatcctaatattgcataacgactagattgagggaaggtgcttattaaaatgcagattctaagagaataaaatacctaggaatccaacttacaaggtatgtgaagggacctcttcaagcagagctacaaaccactgctcaaggaaataaaagaggacacaaacaaatggaagaacattccatgatcatggatagaagaatcaacatcgtgaaaatggccatactgctcaatgtaatttatagattcaatgccatccccatcaagctaccaatgactttcttcacagaattggaaaaaactactttaaagtttatatggaaccaaaaaagagccctcatagccaagacaatcctaagccaaaagaacaaagctggaggcatcatgctacctgacttcaaactatactacaaggctacagtaaccaaaatagtatgttactgctaccaaaacagagatatagaccaatggaacagatcagaggcctcagaaataaccccacacatctacaaccatttgatttttgacaaacctgacaaaaacaagcaatgggaaaaggattccctatttaagaaatggtgctgggaaaactggctagccataggtagaaagctgaaactggatcccttccttacaccttatacaaaaattaattcaagatggagtaaagacttaaatgtaagacctaaaaccacaaaagccctagaataaaacctaggcaataccattcaggacataggcatgggcaaagacttaataactaaaacaccaaaagcaatggcaacaaaagccaaaattgacaaatggcatctaattaaactaaagagcttctgcacgggaaaagaaactatcatcagagtgaacaggcaacctacagaacgggagaaaatttttgcaatctatccatctgacaaagggctaatagccagaatcttcaaaaaacttaaacaaatttacaagaaaaaaaaaacatcaaaaagtgggcaaaggataggaacagacacttctcaaaagaggacatttatgcagccaacaaacttatgaaaaatgcttatcatcactggtcatcaaagaaatgcaaatcaaaaccacagtgagataccatctcatagcagttagaatggtgatcattaaaaagtcaggaaacaatagatactggagaaataggaatgcttttacactgttggtgggagagtaaattagttcaaccattgtggaagacagcgtggtgattcctcaaggatctagaattagaaataccatttgacccagcaatcccattactgggtatatacccaaaggtctctaaatcatgtaactataaagacacatgcacacatacgtttattgcggcactattcataatagcaaagacatggaaccaacccagatgtccatcaataatagactggataaagaaaatgtggcacatatacagcatggaatactatgcagccataaaaaaggacgagttcatgtcctttgcagggccatggatgaagttggaaaccatcattctcagcaaaatatcacaaggacagaaaaccaaacactgcatattctcactcataagtgggagttgaacaatgaaaacacatgggcacagggagggg

SEQ ID NO: 3135 - DNA, 4626 bp, Homo sapiens
ctgggtgagtactctaggcattcctggcagaggatacagcaggagcaaaggcctggaggctaaaaatagcttgcgggcaggggagctaccagcagttcagtgcttctggagtttaaagagcccggcgagggtcatgtcagatgacgccggtccacgagaaggagggtggattatatccttagagacgccatagagtgaggatataatggctctgtaacaagcataaactgtgatggtctgggatgccctcgtcatagacagcccctggagagtcaatggccaactggggatcatgcactctgaccattcaacagatgtcactcttctggtggacggagaagaaagaagtagcttattgacagttggaaagctggcaagtctgggggcttcctccaatggcctggatggtcctaggggctctggagacacgaggagagcccgtctatttgctgacagtggggagctacagcaatggctcccttccttccaagggaaacagcccatgacccacacctccccagcccccatgtttggccagaaaggctttttagcaatttctcatccactcattgcctgctgagctgcaattgccacctcccccaatgctgaagtgtgcagaagtttctctctgatccaggatgtaattagcacctgccaaagtactgggctgagatgagagtgggattccactcttctcccaaaaactgttcctcaagaagcagttggtgtctaggaagaaaatttctgacttggagggattaaaaagtgatcttctaaaatgcagaggcaggtggtgtttgtctgggcgaatgcgtctgggtttacatgtttgatttcagcaagcacactgacagatgcctggtgagctgcaaacacttactttgttcaataatgggcccataaccccacacatgaatgcctcatctgagaatattttactgtgctccccttgacacgagagaatcttctgtaggtaggaagaggttgtctgttaacagttgcttttatcttcatagttatttcatataaagcaaaacaagggacagagaactttagaggctctgtttatgataaattattttagggagctttgcaaccaattagatattcagtgataagtgaattcctgagaaggttgtggtcttaaaggacatagttgcacatggcatcagagtttttctttcaattttttttttttttttttaatgagaccaagtttctctcttgtcgcccaggctggagtccagtggcgtaatcttggctccctgcaacctccccctcctgaattcaaacgattctcctgccttagcctcccgagtagctggaattacaggcacatgccaccatgcccagataatttttgtatttttagtagagacagggtttcgccatgttggccaggctggtctcgaactcctgacctcaggtgatccgcccacctcaggctcccaaggtgttgggattacaggcatgagccaccgtgcctggcctttctttcaattttgaaagaagccaaagttgttcatacacagatgggttggctggccacagtgatagcagtaacgatgaacactgcaccatgccttttggtttctgaagaattttcacattcatggtttcttttgcactcacaacatccttatatccagtttgtagatttatatacagactcagagtggttaaataacttgggcaaaataaggggaggaactgacacgagatgtcatacattttcccagagaagaatcctccattctcctgccttgagaggtttgggtggaaatagagacacgagccttacaagtacatctgttgtattgaattagggtccaacacaattcataatttatctgaacttgattacacctgcaaagaccctatttccaagtaggggtaccaggagttaagacttcaacatatatttgaggagaagcacaattgaacccataacacactgttcataatgagatttgtgatgccaccaatggacctgtaacctgtcatgccgctgagcgtaagtcaactgtgtaatcactgtattagtccattttcacactgctgataaagacgtacctgagactgggaagaaaaagaggtttaatgggacttacagttccacatggctggagaggcctcagaatcatggcggaaagcaaaaggcacttcttacatggtgatggcaagagaaaatgaggaagatgcaaaaacggaaacccctgataaaaccatcagatctcgtgagacttgtttactaccatgagaatagaatgggggaaaccgcccccatgattcaaattacctcccaccggctccctcccacaacacgtgggaattatgggagtacaattcaaggtgagatttgggcggggaaacagagccaaatcatatcagtcactaattgcaacacagcctgaggacataagaaaaacttgtgctgtctcaaattatatcgttaaagacaggaagactctacagatgccgtcatagattatgcaccatgttttccttggctatgtacatttatgagatgaaggctttagctttctctaggaatagcacaagaggcaaggcattttttggaagaggatcagggtgggtttgcaattccagagaagtaagggtgaggtgaaagggaagtgagtccagaaaagggggaaagcaaacacaaagcaatgcacggctgggccggccacagctccctaagaaagatggagctgacttcacagtcacatggatgtcactggggaagccatctgaaccactgcattacagaacaacccattagggtggtggtgggagatgtgctggaagggcaggaaattcatcagccagccccttctgctctcctggctctcactggttaaagctcaccctcatggttggtaacttctccatgaggctatgttgaatcactgagtgcctctggggaaaccagaaccatgcactgtgttccatttgagaccagaagctgtaggaggagccaggtcatgttctgctgtaggagctgccagccgttcccaggcaggtgggctcagctcaagcagcctctgtgctagaggcaagtctgtacggtacagtctggggccagctgcacatgtggaccatgctgctgcagcctaggcagcctatgagtcagcggtgcccatccgcgttgcccagctggggaaggcatgctggaggctggagcaggtgggtgctctggctgccatccaacaaatggccccacgccggaggctgggcaaatccggaggggcaaatcaggacagattccatctccatatgttgtggctctattttggaaacgctgatcagcttgttacacctgtaaccatggatccctgccattcaccagtggatattttgaatgcatgaagttgatctcacgagttttctaaaccattgagctgacaggtgtgggctgtgacctgccacactctcctgcttggcacctggtgagagccagtgctcagatggaaaccacccttcttgcagcccctcctgaggaatcctccccatttcacatgggacagtctttgccaagtcagtacttaccattcctaactctgaggtgcagacctgcaatttgaaagccctacgaggaaatcagcgttgttgcaattgcctttacttggctcaaaagccgggtgagataaatcttctttaaaaagaggagggatgcaggcaattcctcagctcctgtgggggaatttttttaaaaaaaatttttagtagactatctactcgacatcaagtagagatgccccacccaggtccccttttagtaagagcttgttgctgccaatgtccgctccttcagggcttgctggggcttcagagggtgacttcagcccaggctgggcagggaagggcccttcccaggattgtccactttcaatgagtgatcaaggcaagggcttcaactcagccatcgtggcccagttctgctagacaaatccactccagagctccccagggggctgacgaggctttgctgggcctgcagtgcagcttgggttccttgtctgctcagtcctgcctgctggtcctcctgttcaccggtgtctacccctgataaccctctggcacagtgagtgcctcctcacatctgcttccagaggacctaacaggcaacacctctgtgacaaggtcctcttgcctgccctgtgacatgctggatgaagaagaggtgatgccctacatcagtcctttttgaaagagtgagttagtgacctaagcagggcagacgagacaggtcggcgactctggggaaaggaggtgctgtctgccagactgaatagtgtccagagggaatgctggtccatacgttctcagcagggaggtccagccagagaggaaagagcatcataatgggtcgtgctctaagaggctggggaggtgagctgacccaggcacacgctcaggtgggcaggcaccaggaaggctatccaggtaaggacttgattcccagacccaggattaaagtggccagctgaggccatgaatgtgaacttcaggagttgtttcagtgttcaggagctcggctgccactagcccatagagaaactttatacaaattaggagaaggcacctcctgtctgcccagttcccacctggatgtcatcccac

SEQ ID NO: 3136 - DNA, 3460 bp, Homo sapiens
gggagagagctgggcgggcggcgggagctgctctcgcgggccgcggccctcgccctggctgcaacggctgagatggatcttgaggcggcaaagaacggaacagcctggcgccccacgagcgcggagggcgactttgaactgggcatcagcaggtacatccccagcagccactggcttttccgttacacgccaatcagcaggactaagttcacccttggaaagaagttgtaaaaatcggttgatgcctttgaagacctttgttttggaggcttctttgaagggtcttgcatccggttctgaccttggagcaaacgtgttgtgtggcctcaaagaatgtcactgaggctccttttggaacagattcaggaagaaaaggctgtcttgaaaagtgctcccttccctttgtgcaggggggattcaatgaatatctgcattgtataacattcattgtattacgtaactcttgaaacttttacaaatgactttcatatacatcatctgattgttcagacttaaagggtgtcagacatctgctgttgatggctgtgctttttgaacaagggcagtgaagcaaaaactccctcccctcctgcccatcccctgttatgtctcttcctccttgtcttacccctccccctcctctcatcgccaggcttatttgtatttctcctttctgggaggataggtggggagggggaacttctgtacatccgaatcagttttgttcaagtggtagggggaagcagcgcttcctttgccttcatgtctttctcggttcccctggcccttgttaaactcacttcacaggctttatgagcggggcagaagttcccagtcaatggcgtgtgtctttgtttcctctttcactgtgggaatagtgaatcattttcgcctttagcctgaaatagtttatgaggctattacggtctctgagttcataccaggctacccagaaaaaattgacctgtgtcaagtgatcacccagagggacaaatttatcagtctctgtagtttgtcctcaagctgctaggggcttgattagctaactgaaaacatgcctacctgatgcttaaactgaagcattattttagcctgttaatgtggttgtgcagtaaccttgctgtatttcttctaagcaccattgtattttttcatagaaaatttagttttgccatgtagaattgaaaaagtgatagatggtgttacttccaatggaagtacttacacacgcaatagaaaaatatggttttcatcagctggctgtttaggcagggattgactgtgagtctattaatagatggcattttcatgaagaagtctatttatgtattgcactggcttaacatttgatgcgtgtgcaaaggagctattcctacaaaaggtgtagtaacacttcagaacccaggaaagtcctcagaggggaagcccacagcttctgctggaaagaagaaagcagctcaaaagagaaatacagaaagttaacaataagttaagaccacatgattatgaaatcaaatgtagtgaaactaatttttataaaagcagaccaaagataatatatttaaaggaagttaagcctgcttcaatcaaattagttatattcttgttctaattatgttgctattgcccatggcacattcttttgaacatatttagtggcagatgtttgtccagtgattttagtcaatactttacataatttggaatcatcttatgagtaaaactttatcatttacctggataaatgcatcatatttatgtaaaaatcatcatatatatataaatcatcatacacacacacacacacacactccctcatagagtttatattatagtacggaggacagacataaataatgtacatactaaataagtaaaccacagccaatgttagaaggtaattaacgccatggaaaaaagcattaatccaggttaaggggatcaggagtacaaaaggggagtactttgtaattttaagtagggtggttagggtagatcttattttaaaggtaatatttgagcaaagacttgaaagaaatgagaggagacagctgtgtgggtatctaaggggagagcattcccggaaaaggtaactggcaatgcaaagaccctgagtcaggtacatgtttggtgagttcatggaacagcagagagtccaggctggttggagcagagtaagcaggtttgggagtagggatgtggtcagagaggaaataagcaaacagatcgtgtaggacctcagaggttaatgcaaggattttggcttttattgtaagaaaaaggaaagccattgtaggtttttgagcaaagaagtagtgtatggcttggcattttgaaataattactctgactgctagttgaagatagactgaagcggcataggtggaagtggagagactaggcaggaggctgccctactggtgacagcaatgaaactggtgataagtggttaaattctagatgtactttgaatgtatcaccaacaagattgcctgacaccactctccacaatccttcagaagaatagacattcctaattttaaatcatgattttttttaattttagaaaacaaataacttaattgacttagcgacactgttagcatacttatctttcctgtgtatgtgagctctgtaaggcaggcgaccatttcttatgtatccatgtatctttgtagtaccttcgacagttacttttgtgcttgctatgtttgttgaactgaataattttgacattttgtgaacatcactcttatatttgaaaatataatagttgaatattgtaactaaacatatttatgttcaattgattgtaaaacattttgtaacagttttaaattgaagcaattctattttttacagcaaacaaaaaaggaaaaaaacgaagacagtgaaaatgattggagtattaacattggtaagctgtgaaatgttaaatgtgaataatcctaccttttattcaaatttgaggtattgaatcaattacctttaaagcaaatactttaagattgtctagctaggcgagctgactcatacttgtaatcccagcactttgggagactgaggtgggagggttgcttgagcacaagagtttgagaccagcctggacaacatagtgagatctcatctctacaaaataataaaaataaaaatcttaaaaaatagcatatgtcatggcatgaacctgtagtcccagctacttgggaggctgaggcaggagggtcttaggagtctgaggctgcagtgagttatgatcacaccactgcactccagcctgggtggcagagcaagaccctgtctcaaaaacaacgacaacaaaaaactgtctgcagacagcaataaattgtccttgctgcacctgtgctgtataagtttggcttattatagtcaatgacccacattcttaagatggatgattttttaaaaagtagagacaggctggcgatgacaccggacagag

SEQ ID NO: 3137 - DNA, 1750 bp, Homo sapiens
gtagataccaacacagatatagaaatggaaatggaagcttagagaaattaagtaacttgtcactgtaagagccaggtagtccaactccagtgtccaggctcttaaccactgttttgccttagaatttatcccatcccagggccactgtagttttcaatgcctagtgcttagattagaacagtgctcagcacataaaaggcatttaatacagtgaatctttattttagatctcattcatcctcagagttgttataccacttatgtattaagtactttctgaaacaaagcatggttacatgtgtcaatatttcccctgttttgcaagtgaggaaaatgagactcaggttaggtatccagcccagggttacacagtggcaaagccaaggcttaagatccgggtcatctggactttaaaacttatctgtggctgggcaaagtggctcacacctctaatcccagcatgttgggaggctgagacagaaggatcacttgagcccaggggtttgagaccagtccaggaaacatcaggagactctgtctctacgaaaaatttaaaaattagctgggtgtggtagtgtgcacctatagtctcagctactcaagagactgaagtgggatgatcagttgagcccaggagtttgaggctgcagtaagctatgatcacaccaccgtactgcagcctgggtgacagagcaagaccccgtctcaaaaacaaaacaaaacaaaaaaaccttacctgtgcatgagtgagtttgaagaaggtgagaacttgaacacagtagtgatcacacaagagaattctgcagaaaaaaaaaaagccccaatgaggtaaccctctaacccttctactcacatctgttttgccttgtatgcattggacttcaggcaattacctttctaagccacatattcctcgtctttaaaatgggacaacaatagtacctacctcataagattgttttgaaaaataaatgaaaaaaaacacttaaaaggtattccacatagtgcatagcacatggtaagcccttaataaatgttagcctgtatcatataattattatagagtagtattcaatggccacattttttattgcctccaatttccacaaggtggcatgtcaagttcaaagtgaaccccacggccttgcatcccaatggcaaaacctacttaacttgcttcagaataacatggccaaatctaaactgttggaaacttcttctatagaaggtttgtcatggttcagaaatcttattgtcactgtaaactccttcttaaggaaacatgtggaacatttaatttaatcatctggcttctctggattcccaggaccatcttcatttacatgaatgtgcattagctctgacatggatcacctgcagaattgagtgcattcatgtcatctcattaagccctaagtttagtccctgaagattgaaagaagagaaaaatagccagctgcagagagtcctgggctctgtggttggtgagctgcagaagcagaagatactgacaggtaataagagggccaagtagaccaccctgccatggattggagccatgtaagacccatcctgtgtacactcagagctgactctttcctaggaagtgagtggtatggatagacatgcgtcttttccaattcttcctgtgcctcacctcagtcttcaggactccaaggaggtaggaccaaaaagcacagggcccctgagtgttatttcagatcctctgtgtaaccagcccacacctgag

SEQ ID NO: 3138 - DNA, 2861 bp, Homo sapiens
aaaattccctaattttataaatagtatgtatattagaagatatctgtaatcttgaaacttagagatggagctgactttagaaagttctaattcaacatctaactcagacttttgatgttaagtaataatcgtacatatgtattgctatttgctaggcacttccgtaaatgctttaaatatactaaattctcataatattcctaagagataggtaccattttcatcttgtttcacagaacagtaaattgaagcataaaaaaatgtaagtaacttaccagaagttacatagctagagttgaaccttggcagtgtgagtctctgagatcctcatcaccatgctacattgtaaaagaactataccaagacctcctggaagaggttacttctgccccctctaagcatctgaggcctgatgctgtctctgagtactttctgggatttccatattttgctctaggcaactcttctcacttccatattcgaaacctgccatatgaggttctaaaagtaaggacaaattgtcacagaatgggtcctatctagaccctgctcttttattttaattctgagaaaagagtatcaattcagctatacagaacccaagtaccttttctttctcaactccaggagtctgctctctgttggtgctaaatatgggcaaaaaatgtcaagttatgtagaaaggactcttgtataaaccttttggagtgatggatggctgcttggtagtgacagtgcaataatggcttccctgagtcattgtgctatgcctgggagaagtgagaagtcagggacaactggtctcagagagggagcagttcttcagcttaactttgtatggatcaagttcttcattccccatgacagggattatatttcagtggtcgctaatttgaggacaggatccagacagagattaatgagaaaccctaaccctctctggaatgtgagcctgggactgcagagcttggttccagaaaaactggtttaagaagccagaagcccaaattgtctaaagtaggatattagacccttggctaatgaaagatgagcaccctgaacataggccctggtctggggcttggtgtgcaatgttcagatcatgctcttaccttgtaagttcaatcctgtgatgatcagcaagaaggtgactcagtatacaaacaggcatatttaaattttaaatttccctgaaacatcaggattatttaaaatctaaagcgtgatgatcatggcccctccttcagagaagcatgtaagaagattagttctgataacaggaaggacttgattcatttgttcaatttttcattcaaccataaactgacaagtatttttttggtacctatgccaggcattatgctaggcactggggacacaagtaacaaagtgatttaagtaacttgaaaatttggtaaagggtggacatgaaataaacatgcactcaaataaatgtataattttatttatttatttatttttagacagagtttctctctgtcacccaggctggagtgcagtggcacaatctcggctcatcgcaacctccatctcccaggttcaagcgattctcctcccaagtagctgggactacaggcacatgccaccactcccggctaatttttgtatttttagtagagatgggctttcactgtattggccaggctgatctcagactcctgaccttgtgatttgcctgcctcggcctcccaaagtactgggattacaggcatgagccactgtgcctggcccataaatgtatagttttaattgtgttaaatgccaagaaagataataatgggagtaggagcatctaatttctctaggaagatctttctccttagtaaatcttgaatcctttggggatcccacttagggaaggtttatgaagactgctgggatctgatgggatctccataaatatcagaggatataagtggatttggaagcggaataattttcctttctggtctgcacattctctcacaccatacattagccaggtatgtgttattcccagtttcattccgagcacctagacacaatggctagcatgtagtaggtattcattaatgttaattgaataaatgaataacttaaaagccgacattcttttacttgtctgtttttgtttaagttgttcagggcagagctgaaagtaggagatggaatcatatcataagtcccaaaccgggagatgacctacagaatatgtgaaaagcttgtgaacaataccagagagaaaaggatagtgaagtcaaagtccagttggaaggaaaagaaattatctcatattgagacttacagatcaggatgaggcaacaggttcctgccagtaaaacttttcattccagccttagtgactatcatctaggccttcatgccaggatggcagagaaatgctgtctctgctcttcagtgcctttcaacagactttcagttatgagatgaacaaattctgggaatctaatatattgcatgggtggtgagggatgtattaatgaatttggttgtggtgatacacagtgtttacaaatatcaagtcatcatgttctacactttgaatatatacaatctatttgtcacttaaatatttttatcaagaaataaagaaaatgagaaggaacctcttcaactctggagataccaatgaatcaggtaatggcagaatgaggaggaaggagaagtatggagagtttgaaacagagaacaatgaataaaatgtcttttcctttttttgtccttaataacaaactttctaagataaagtttattttggtttaactttagataaccctattgatatagccaagtttccacagtaatgtcaacagtagaattgtgcaggctctgaaatgagg

SEQ ID NO: 3139 - DNA, 261 bp, Homo sapiens
cttatttatctcttccccagcttgagtctgggtcctactgtcttggccagggtaagcggatcacaaagtcaggagatcgagaccatcttggccaacatggtgaaaccccgtctctactaaaaatacaaaaattagctgggtgtggtggtgcacacctgtaatcccagctactcaggagactgaggcaggagaatcgcttgaacccaggaggcggagactctagtgaaccaagatagcgccactgcactccagcctggcaac

SEQ ID NO: 3140 - DNA, 2586 bp, Homo sapiens
ccatggccagtgtcagccaccaggcatgtgagtgaatgaaccttcagatgattccaaccctgagccttcgagctaccccagctgacgcagagcagagcagagatgagctttccctgccttgacctgtccaaatgcacattgaaaatggtaaacaagggaaagaaagaggagttccagaccctgcataccaaaatattacagacacacaggaaatgactcttcaaatccaggctgtaaacctgtcatttcgtgggcttgtctgtgggcctagaaaagcgagacaaagatcacaccgaagacattactgtttggggctggctgtactggaggacctctggaggcctttccatgccaggtgctatgattctaaactcaagtcataaaatgaaatgttagaggaaagccaatgaaatttgaggcagaacttgtggcttaaagctcattttgctttaaaaaatgtagactttgaaaaactgttctttacaagcaacaaaaattttttaaagaaactgaaaagctaaaaaatattttttggggggagggagtaatattctcagccctattactatcttttaaggctttcgattacagatactccaaacatgtaataagttactaagtccttaaaatatgtattaatcttcctaaaagatttgcatattgactttaatccacgtaaaagatgtttctggtgtatttaaccaatgctgctcgtctgtttagtgaaatggttttggatccattaattctccaaatatttgtattctgagtgccttctaaggataagacattctttgaatcaaacacacacaaagaactaagccaatctaatggttaatgcagtcattcctccctcctccagcttaatgtactggccccggagccagaatgcctgggtttcccagctccagtgccttgaacaaattacataacctctctgtaccagttctctcccctgaaaagtagggttagtaatagcacctacctcatcaaactaaatgactcaatacatgtaaagcatgtagaaaaatgcctggcacatagcaagcattcaataaatgttggctattcattttgtgcccagtatgagggaaagcaatgtagaggtggatatggagataaataaaacaaagtgcattaaagagggaatatttcaactggttcttggagaaaatacggagttcacaaggaagacaaaaaagggccaagtcaagcaaatggtgtgagtgaaggcacagaaccacgaaactaaatagcatatctggggaattgtaaatgattcattagagctagattaagaggcatgtgacatatgctgcctccatccaaaagcaaagattttaaaaaagagagagaaaaaatagaggcacatgggaatgagggagtagaaaccacaggatttactgaccaaacctatgtgataggaagtgaggtagagcaggtttctgggtttatggtgatgccattaatcagaaacaaaatgtggtacatggtgtgacctttgacacaatgtgtttggacatacagtatgggagggacctttaagaaccaagtggagatgtacaattggatacacaaatctaggctttataagagcactctggcaagccatacagtataggggatcatcaaagtgttactgattgtagtagccatgaacttggttgaaatcttcaagaacaagggtagagaatgagaagaataacaatgtagactacactggcaaccaggggcagttggaagagaaggaaccagagaaaatagaaccagaatagcatggagccctggaagaaaccaaaagagtaaatcagttttgcactaattgatggttttagtggaaaaatgacagaaaacccaattcaaacttgtttacattgttaataagacatattggcccatataactgaaaacacaagcctctggatggggggatagcattataccaagacaaatgagaatcaaccctaagccaggggtgaggaattcagcttacttgcaacatttagcagtcatattgagtgcctactatgtgccaggcattgttctagtcaatgaacaaaacaggcaaaaagtcccttgtctgtggacagaacacacaaatgcctcttggtatctccccacactctcttttcattgaaaggcaatgcttcaaaaaattggaaaaattatctatgtggaggaagatgaagagagaaaactttagaatgtaatgcaaattccaaaacatttgctgggaattttaacacgattttgtaggaatatgtgaaacttctgtactattatgaaatggaggggtgacatagggaagcagtacagtatggataaaaattctaaaattccaaaataccacccatgttttaaagtccagttatgaattcagattagtcagtttttgacttaatcaaattgagttgctgcatttattcggattatatagacctgtaaaaatacttagaggtttcaaatgtctctggtagagctttgtacctaacttgtgtgacatattttaaatgtagattatgttcaaacctgcattaatccattcatattttaaatttaaaaatataattagcaataaaagaaagc

SEQ ID NO: 3141 - DNA, 32863 bp, Homo sapiens
cgattctcctgcctcaggcgcctgagtagcttggactaccggcatatgtcaccacacccagcaatttcttattttttaattgcaaagaaaatctttacctttttctttctgacttgaagcaggtcatcagattgtcaacagctgcacctttcctcattttgatgcttatttaccccctttatttacccccatagctactcccacacagctgaaataaatgggtaatttattagaacccagcctcttaattagttatacacctttaacattggcttgaatcttggaggcccatcccagcacccacattggttccaagattttcagcctagtgtagtggctataaatagctcatttctatctacacttaagttttgaaagaaggaaagaaagaaagagagacagaaaaagaaagaaagaaaagaaagagagaaagaaaggttgctgtagttagagtcagaagaagagtttgttgaagaagtagaatttgttgaagttgttaattctggtaataactgctaaccagctgctagatagaaaatatgaagagagaaaaatcgagccctaggtcaccattacttcactgtgcctctgacattagctcttcccccaggatatacataggagatatgcttcctgagagaaaggaccacgcttctcctgtttaccatgctgtctcccactctagcacatccttcagcgatgctgaccggtggaaaccagagcagtacctcgtgtatactacgctatcgtaagctattataagcattgttctttttcttctcccacccagaaacctgaaggttttcttttccttactctgttcctctgtgagttttgagaatttctgtacctctcttatgatacacgatattactggcatagtgcgttcataacacttcctagatgctactcatatgtggcatgagccttcttaatcaacactaaactccttctaaactaaaaagcataatccctgttacttatatctgtatttaaagtggagttttccctgagttgtttctttttcttttttttttttttgagacggagtctcgcattgttgcccaggctggagtgcagtggcgcgatttcggctcactgcaagcctagcgggttcacgccattctcctgcctcagcctcccaagtagctgggactgcaggcgtgtgccatcatgcctggtaaatttttttgtatctttagtagagagcgggtcttaccgtgttagccaggatggtctcgatcccctgaccttgtgatccacctgcctcggcctcccaaagtgctgggattacaggcgtgagccaccgcgcccggctcctgagttgtttcttgtagatgaaacagtaatttcttggtctgcttatattattttgcaaacttgtcttttactttcacctaaattgttaggataaagtaaagatttagactgattattggtacagttgcatctcactactattgtactgttcactatttcacatatacaataagaaactatatatccctatattatatttgcctaaaggcagaaggaagattaaaggtaccatctaactcagtgtttgctcattatgctcattttcatgttgacaaacttctttatgaatataacaattattccttgatttctgcaactcatggcagcactaaaatagattacagctccaggtttatgttctgcttacattcaggacaagggctctgaacaattgcacatttccaggagaggagtttccatggaaacttggacaaaggcaaaacaaaataattcttcaaggcctatgagaaaaaaatttcaccttgctttttatttgcagttctgtgtcccctgagcagttcagccagcttgcagctgcccttgctctctaggaatccccgtttgaaaattatatatagcattatgcatctctgaaatctgcaaaataggatttgatgagtgtaaatgaagagttatttctctggaaggctcaaacccagaggtttattacaatacaatttttaaaagttaaagcatacatttaagtagccactgaatttatgaatatggaggtgtttttcaaattataaaatccttaaaataggcctcaagaagagagttttaggataaataaatggaatcagtgattagagacaattaggcatttcaaggcaatttgctagctgaaaataaagaccaggtcaaatgattttcggtaaatgtatggatcatatatcttgggtaaaaggaagtcagggggttcatataaagtccttcggagaatgatgtgtctcctgttggtttgcaaaatcctgtacagcacgctgtcttatttattcttgtatcttctatggcactaagcacagtatttttaaggcactttgggggctggatgggtgtagtgaagagcattcaccatctccctcaagagtccagcatcacagtcagaaacagagtactctctgcttcctaggcaaaactattgacactatttaataacttcatcatacagttcatattttatcgaggaacctgccccgatagtcacataggttcttttctattttccctaagcatcggccggtttgagaaataaagggacagagtacaaaagagagaaattttaaggctgggcatccgggggagacatcacatgtcagtaggttccgtgatgccccacaagccacaaaaccagcaagtttttattgggactttcaaaaggggagggagtgtacaaatagggtgtgggtcacaaagatccgtacttcacaaggtaatagaatatcacaaggcaaatggaggcagggcgagatcacaggaccacaggaccggggcaaaattaaaattgctaatgaagtttcgggcaccattgtcattgataacatcttattaggagacagggttttgagagcaacaggtctgaccaaaatttattaggcaggaatttcctcttcctaataagcctgggagtgctgtgggagactggggtttatttcacccctacagtctctaccatagaagacggccacacccaagggggccatttatagacccaccctcaggggcatattctctttctcagggatgttccttgctgagaaaaagaattcagtgatatttctcccatttgcctttgaaagaagagaaatatggctctgttctgcccggctcaccggtggtcagagtttaaggttatctctcttattccctgaacaattgctgttatcctgttctttttttcaaggtgcccagatttcatattgttcaaacacacatgctctacaatttgtgcagttaacgcaattatcacagggtcctgaggcgacatacatcctcctcagctgacaagattaagagattaaagacaggcataggaaatcacaagggtattgattggggaagtgataagtgtccatgaaatcttcacaatttatgtttagagactgcagtaaagacaggcataagaaattataaaaatattaatttggaaaacaaataaatgtccatgaaatcttcataatccacgttcttctgccatggcttcagccagtccctctgtttggggtccctgacatcccgcaataatatttcactttcttttcgttattgagcttaattgtaatcatattcagaaacatatccactcttcgatgcattctttcaacaataacttctgaataatataccaagtactatgccaggaatgtgccctcaaggagtccataaagggctgctgactttaaaaaaagatgatacaaaactaaagaaaaacacagacaacaaaatgtggttactgtactctgtaatatctcataatgttgaggactgtcatgggttttatgggtgtccagagcaggggcatgtgactcagctcagtggtgcctgtcatatgggggttagatcaggtaaggccttcacagagaaatgtttgttctcagcgtttttgttgttgttgttgttgttgtttgtttgtgacatggagtctcgctctgtcacccaggctggagtgcagtggcgtgatctcggttcactgcaacgtctgcctcccaggttcaagtgattctcctgcctcagccgcccgagtagctgcgactacaggcacatgccaccacacccagctaattttttgtatttttattagagacagggtttcaccttgttagccaggttggtctcgacctcctgacctcatgattcacctggctcggcctcccaaagtgctaggattacaggtgtgagccaccgcacccggcctgttctcagtcttgaaggatgattagatgtgaataaggcattcaagcagggaaacacattcagagagaggaaacatatgtaaaaacacaggaacatggaagaatgccaatgtttcaggcactgaacattgggtttaatgtaaggagtaatgggcatgagcttgaagaaggcagaagccaggtcctcaaatgcctttatgtgaagttaacaagtgggaattttatgctaaagatagggaacccagtgagttatctcagtgaaagaagggctaaatctgtaccattgtcctaatttaagtgttaggggcagaggaagtccgtaatagaagggagaccagttacggggcaaagaggcaatattgactccctatagtgagggtcaaaactacagtggtatagacaacatggaagggataaggagatctggaagatagatgagcttggtaaccaattgtttcggcagggtataaaaaagaggaaggactggagtggatttcaaatttctaatgcaagtgctgggaaagtggtaatactgttaagtgaaattagtacaagaagcgaaaacaaaaaacaaacaaaaaactccataaagattataaagatttagggtatggctttagcctgactgctcacctgacctcaaacaagattcttaaccactttgagcctcattcctttgagatgatcatgtgggattgtttggaggattaaatgagataatgtttacaaaacattcacacatttgctcaatctatattttctgagcatttattgtgtaccagggtaaggggttcagagttcagaggtgtttaagacaaagtttctgctcttataatatatctgttgtatgtatgggaagatagacataaataagttaacaaataaatgagtaaacttcgaaaccccctctctactaaaaatacaaaaattatccgggtgcagtggtgggcacctgtaatcccagctactccggaggctgagacaaaagaatcgcttgaatccgggaggcggaggttgcagtgagccgagatcatgccactgcactccagcctgggcgacagagccagactccttctaaaaataaatatataggtaaactaattatagatttggaagcgtgctttgaaagaaataaaaatgttgatgtgacagttacagacagggttgagagttctactttttgataagttgttaagaaaggctaaaacttgcagggagttattcagtcagagacagctaatcatagttgaggaacagcatccgaggctgagaaaaccacaaagactctgaattgggaaagaatttggaaggacagtacacacctagcaaatccctaaatataataaacacacaataaataatagatattatgtttagaaacaagaagacatgtattgattatatgccatggaaaactatctgaacaaaatacctaattcatttattgcatacataatatagtcagaacaatatttaaaattgacacatttgcaaatgtatctttatatttaagaacgtgaatacaattgtaaatggagtgaagggttgggaaggagttctctaaagtaatattgaggtttatggactaggaattcttgtagggaattgtgtgattaatatgcttccccatggtattggaaatatatttttctttattttccaattagttttttatttgtttgagtcagactcaaccttaacatcagtggatcctccaaagatgggagactacctttttgaagactgcaatccacacaactctatatagaaaactctatgttaactttcatgcttttagtagaaatctctattattagtcactgctgcatttttttctgtgcagtgatagaagatatatcatctatttttttttttttttgagatggagtctcgctctgttgcccaggctggagtgcaatggcgcgatcttggctcactgcaacctctgcctcctgggttcaagtgattctcctgcctcagcctcctgagtagctgggattacaggcatgcaccaccacgcccagctaattttttttgtatttttagtagagacagggtttcaccatgttgttcaagctggtttcgaactcctgaccttgtgatcctcctgtctcagcctcccaaagtgcagggattacaagtgtgagccactgtgtccggccaatatatcatctaaatgataaaaaaatcactcaatatagattgtgttacattttttaaaaattgcaaatgtcatatgttatacagggaaattattaagtaactatcccgtcctagtgttcaagtgttatgtctgagagtttgctgttttacatgcaaaggaaagattataaacaacttctgtaccacatcaacgaagtcattcaaatttgatattaatcctagttaagcaatttgcctggcattcatttgatttgtcttcttaaactagaatgcatagtaaaaatgggttgcaaatatttggtagttataaatttaggattgaaaatatagaaacattaaacttagactgatgtgttaaagcatgttgataatatcaattaaaaatttaaatgtcaaaggaattaaccaaaaaagaaatagcttagcagacgttaaaaccacaaaacaggaataggactattctagaattcaatgaatgacagcctccacgtctgttcagagtgaattctaacaaatagctaatgaatataaacagtctatttaagtgctgctggaaaattccccttcaaccagcagctgacatgactgttgtcattcaaagggcataagcaaatgtcaaataattgaatcattgagaaactgagatgacaatggcctacattctccttaatgctttttgaaaattcttccctgggctattcaatagatgatgtttaataacggtattaagctaaagaaaaaccacgggaagtcaaagtttaaatagggcttaactctttaattggagattcctcagggaaattggctgtggctcttgcataccaggttgagtgtgtttctgtaaaattgcactgataggatcctgaatcaccatgttttatagataagagaaatacaaacttcacatgaaacaatgtggtgctccaatccagtatgaagattgtcatatcctagcacaggcagcgccttccaattcttttcctgccttcctataactgagtatgtgtgtccttaacatttttaaaggaactgtaggccagcaaggtgctctttgctagaattaaggtccatgttctccttgtacccccatttcctgtttcttcatttgccgttggcttttatctggttttcattaactcagggacttacatatccattcattagttggcatcttctagcctgacaccgtgactgatcttggatttgcttcttgattcttcctttgtctcttggatccaatataactatgtgtctttggaactaactccacacatttttctgtttttagtcttgctacatcctgctctaaggcgagtgggttataggtatatccagcaataccattctagaaaagacaatctttaataatagaggctctaatgccaaatcccatgcatcttttagtaacgaacagaaataacttctacatccttcaagtttaaaaatattcatagcagattctcagaattttaatggttactcagatttgagctctgtggcataaattgtccagctagtctgtaggagcaaggcaggttattgcatctggaactatagcaagacaacaaaatcgattattctagatgtaatctgaatacttctataatgttcattaaagatgtactttaattatgaatacaaaagttaacattaatttgcaaacattgcaataagttacatacagttgatgtgttaatacaaactactaaaacaagttattgaaaaattctctgggaattcatgaaatgatctttgttctagatcaaaatatacttgtttatcctagatgcatgaaatgtggtgatgatgggataaatctgattccaaagcccacacattaaaactagcctccctgttttagtcatatatcaaatatgtccagtagtggatacttttgaggctccccccagaggctctggatctcctttactgggtataaacacccgttgctcagctcctttactcatagttttgccactaacagctgttaccagcagccctcttccaagactatctttgggctacaaattgctttacccagcagctgggaggcagggttgctggaagtgcctgggaggctacccttctcaggtaaaaggagagattaattctgcagatgagtaccatagacacaacattaacatgagtctaagaagcacatctctcacatttttacatgttttaactgggatgcaacttataatcgacttgttctacttcaagtggtagtttactttgtacacacaataaggatatgtctgatgtttgatggtgagttagagtcaatgaaattagggactagaaaagagtgaacaaaaactgtttgaaaataatcatgaagaggtttaggaaaaaactaacatttaaactggtaatatgtggaagtgtcaggcaacccatcctatcgttttgcaagtatgctatctggaaattaaggccaatcgtagtttaggtaaaagttaaaggaagagagcaacatttaacagggatcctactgtgtgtccagcactgaagtaggttctctgcctccagcaactttttcatttcataataaatttttgggccaggaggtgacataatcacaaggaaattttttgaagaagatccaggcccaaatcagatgcttgagaatcactgcactgattggcatcaagatggttttacaaccatctgcttttgatgacttctattttcccagcagccaaacccctattctaggcaggaaaatcattagctatagaggaggcagatctgggttctcatcctcattcagtcattgggaaaccagtggtcaccaagaattggactctacaaatttggcttcttatatacatcctttccaggaccaggaatggcctgaagtgggagagaacctgcagtttggaagtagagagatgcaataataggtagtcaggcagaacatctttggggtctttaatctgttcatcacaatataaagtgctgtcttcattaaatctagtatttgagagattttttctatcaaataatgtttaatcataacagtccatttcattcatctataactgtcaaatggagctactgggcagcaaaaaatagctaagagtaccactttgaaggccgggcacggtggctcaagcctgtaatcccagcactttgggaggccgagacaggcggatcacgaggtcaggagatagagaccatcctggctaatacagtgaaaccccgtctctactaaaaatacaaaaaattagccgggtgcggtggcgggcgcctgtagtcccagctactcgggaggctgaggcaggagaatggcgtgaacccgggaggcggagcttgtagtgagctgagatcgcgccactgcactccagcctgggcgacagagtaagactccgtctcaaaaaaaaaaaaaaaaaaaagaaaagaaataaaatgcatagcaatataaaaagaaaaaggaactaaaattctatctgtagatcccaagttaagaacccctgggaagaagcttgcttcaagttgagtgaaaaagccaggaagaagtagccagatgatgatggtaagaaggtagaaaagagtattccaggaaagagaaatattacgtggaaagagtaagaggtaagagtaagagtaagaggccaaggcacaggcaaagagtttgctttttcagctcaaaatttaagggtactgtaggtccagctaaaaacaaagagacttgctctttttaatcatctgtgcagctataataagggcacatgtatgatgcgtcctttagtctatttagtctattatactttgttatataaacagaatatataaaaatctttctataaattgttctctatgattatgtactagtgagaaaataaacatgttgttttagtatatcaagctgcaaatattactatgctaactttcaaaatgaatgatttaaaatagactatactgatctgaatcactttttatgtacaatattaaatcaggaatcaaatcacagctggggacctaaatgtatatttataagagatattcttctctgctcctgggattttcattctgaaatacctttagtagaaaagcaaagcacataatagtagttgaacttttctgtaatgtgtttctggagattaggtcattatgcgggttttaaaagacatgttacaagcatcagatattgtgtttccattacatggggactcaataagtacttaaatgaaaccaaaaatacttttcatcgactaacgaaaagaagagcaatgcaataaaaatatgctagctaaagacagtttagttgtgtgtgaaatcatggattcacccagtccttaaaatcagaaaaaaaaaatgaaatgttttaattgtgagccttctgcttaatagcttctgtggctgaaaaaaatccctgagactcaagtttccttatgggtaaaacagggatactaatacttacactttggtattaactaaagagagcactaaagacaaagctcttagtacagtatagcagtacactgtagtttcctcttctttcacctggactctcctgacatctctctgatcaccccacttacatatacagatagctcaggaattgacagaaaggagtagaagaagttgggtagtacagcaggtttgagcagaaaacagactagagtttctatgtaaaatttttaggctattgatttgaaaatcagacttccccagatagtttccagatactagagttagctatgaatgaattttaatcatttagagaccccttatgtgatagcagtttttataaaactatgctgaaggaacagtaagggtagataaattaaaacaagtttcaatggcacatgcctgtagtcccacttactcaagaggctgaggcaggaggatcacttgagcccgtgaattagcggctgcagtgactgtaatggagccactgcactctagcctagacaacagagtgagaccccttctctaaaaaaaaaaaaaaaaaacctcaaaagaagaatatgttctgagatatattttctgagatggaacaacataatttaaaaggggttatatatacataggaatttttcttctgatatattttaaactctcaacatttgattgagtttgacaaactatattgggaacctattaggtgtcaggctccacacacagtacttcagatcccaaggcagataagatgtgcttgctggtctcaaataagtctccgtggaatttagaatatttgtgggtaggaggtagtgggatgggtgaaagcctaggggaggggcacccactatgcaccaaaatagctaaatattcaatgacattaatgcaattataatataattccagtatagggtcacaagcagataagtgagctatttaattctacctggggcagaagaagcctctagggaggtgacaggttctgggattctaaagaaaatgtatatatagacccaggtaggaaacatatagtggttgaggactaaacccaatctgaggaaagatgaagagattttctgcaaaaagcaaaacagactgctgaattatgacagaaattgagagaccacattctagcataatggttttattttttttcctctcatcatatttttacacacatactcactcatacatattcttcaggagtttgaaaattgtttctcagtcttgcttttcacattaggaaaaaatgtagagtaactggatccaaatgttctgtcattctgttacacagaaagaaggaattcactttacaagaaaacaatttgatgctttgtttacatttatgtgaatattcaccttcaagtgggcctcacttacacaggcagggaggttctgcaagataattggtaataggcgccctaatatttatatttagtaggtattctgtggatggtgctccttctcatctatctctggggcatctgctttctagaattctttatggtgtccttgttaatccatcctgaattcaaatgaaccaagcaaaacacaacatttaaagtgaacaaatgtgtttaattgcttcattctgagaaacaagggaaccaagaaaggccaaatcaattgtgttacactaaaccaacaaagacttctttgcaagaaacccttgttgttatatcaatatttattgcttacttttcattagaagctacgcgcaaagttgcagccctctccagagtgagaaatgttgagacacctacaaagcaaattgccttgcttttggcttgtctgtcggttgttattttttaaaccatctatccatgccccttcccatcaccatgcctaacatagcacttcttgtgaagatctcttggtggttaaacaattcacaattattaaatgtgactttctagaagttgcagtcacctggataaacgggcttttgctgctggaggttggtagggtaaggagggtggtgagtgtttgaacagagtattgtggaataaatagttgagcctgctgtggcattctgccacaggtcctcccagatcccgtcttcttttgctggaattccctggctcccctccagttcacccaacttatcaaacagattgtttggcaaaggatagaaagaggtagaaaataaagtgaaattgaagatttgggcagacacactcctgtttctatgtagaatctcctaggctgttgatttgaaggtcttagtactccaggtactttacatatctttgggttaaatatgtatacgttgtcattttaattgccaaagttacttgaacttctacataacacagccacattttaagggactttaaaaaagaacatgtcagttttgctcctaatggataagtgcataccacaagtgcaacaccacctgatggcttctctttctttttttaagtgaagtaggacttggctagatagtaactgattctagtccatgagacatgcatccatccccattaacctgtaatctatgattgcagtttctctatttagtttgacaaatgaatcttccaaacaatgaccagctcttttggggaatgtgaagctaatgatgctccttcttttacagaactagtttgacattccaattgtgctttaaaagaaacatacgtttttaagctttttactgcatagaattagcattctttttaactttttgactattcatggacataatgaacaagctgttctatttgttgactgtggatatcctgtagcttctaggctgcacatttcgatatgcaatagagttgtaataaaatatgagcaaggcaataaaacaggaaatattgtaatatatttttgcaatgaaggctttgaatgcagaaagttcgcagatctcttcattacagttccagtggatagtttatttctcagctttcattaaaagaaaaaaaagttgtggatgtgtgattctgctgaataaagctggatataaatgaagtatctgcaacacaatcgtaggaaacatattttttgttttgctagtacttgcttatgttactcatatgaataatatgattgatttttactttatctccaactggcagtatagtcataaatctatctgtgagttaccaagtgcaggataaaatgttatttttcctcagtgtggtctcatttgattacaattgcagccttgcctggctgcattccatccataattaatcgtctctttggtttccagttgcagcgaggccagggctgtaaccgttcacatctttagacgatggtctactacgccagctggcaagtgaatggagacctttcacactgagtctaatggacgcagaaggctgaggctttgtcagggcagctctttaaatgacatcgtggcagtaaaggtccaacttgctgtggctgacagtctctttggcacctcacccttctgagtaaacaccatatgcagagaggtttcattttgccaatttattttagtgcctttcattccatgatagaaagtattctcagtggtgataggaaaatgaattcctttaaggctttacctcaggggccggatcactctctctttcctgtgtattgtgttataaaatcccattagcattagtgactgtcattttgtcataatatagatatttgtttcctatcatattatttattacttgggcatatggttgcacattactcccagggaaagaatgtgaaatatagcaggcaaaaaagttagattaagtatccacccacgtctaacactgagatttatttttgagcaagagggcatgttactactcaattattggtacaaagacatattagatgtaattttaaatagatgtatttagtacttattttgctctctgtagtgctactttaaaaacagcaaactacatgggttcgtatcatttggtataaattatgatagaatcttataaagtgtcagaactccagtccatttgtgattgttcaaaaaatatttaagccagattctcaaactcaaatatctttgggagccatgcaggttactctgagggaagtgggtcaagtacaatgatttcgagagaccaaggataacattaaggaagcagtcataaaaagggcagctctagcagattattggcatgtggggaaaatgaagaagctaaggaaagtgggtctgttacaggaaaggggtccccagtccagatcccaggagagggttcttggtcacgcacaagaaagaattcagggcaagtccatggagtaaagtgaaagcaagtttattaagaaagtagaggaataagagaatggctactccattgacagaacagccccgaaaaccgctggttgcccatttttatggttatttcttgattatttgctaaacaaggggtggattattcatgcctcccctttttagaccatatagggtaacttcctgatgttgccacggcattggtaaactgtcatggcgctggtggcagtgtagcagtgagggcgaccagaggtcactcttgtcaccatcttggttttagtgggttttagctagcttctttactggaactggttttatcagcaaggtctttatgacctgtatcttgtgctgacctcatatctcatcctgtgacttagaataccttaactgtctgcgaatgcagccctgttggtctcagcctcattttacccagctcctgttcaagatggaattgctctggtttacacacccctgacaggtttagcaatggcaccagaaatgatccttcttttgtcaaaataagccagatatctagatttttatctgacaccccttgtttttaaatgttaaaaactgcaaaatgttcaattaaaaaaacatttttaaaaagttgctatgtttaaagagggctggacctgcaagctgactttgcattgtaccaaaagtcttagaataagacattaaaaatgagcttcccattccccttgagaactatgacaagacaaggatgcctgctcttgtcattcttatttaacatagttctgaaagtgctagacagagcaatcaggcaagagaaagaaataaaaggcattcaaacaggaaaataagtcaaaatatctctcttcattgacaatataattttatacgtggaaaaccctagattctaccaaaaagctctttgaattgataaacaacttcagtcaagtttcaggatacaaaataaatctagaaaaatcagtcgcatttctatataccaataacgttcaagctgagagccaaatcaagaatgtattctcatttacgatagacactcaaatacacacgcagacacacacacacacacacacacacacagatacctaagaatacatctaaccaaggaggtgaaagatctctcctcaaggagaaatacaaaacactgctgaagaaatcagagatgacataaacaaatggaaaacatcctatgtttatggtttggaagaatcaatatcgctaaaatggtcacactgcccaaaggaatttatcaattcgatgatattcctatcaaactactaatgtcattttttttacagaattagaataaaaccattctaaaacttgtatggaaccaaaaaagagcccaagtagcatcctaaacataaaggacagagccagaggcatcacattacctgacttcaaactatactataaggctacagtaacccaaacagcatggtactgatacaaaaacagatgcatagaccaatgggacagaatagagaacccagaaataaagctgcacaccttcagctacctgatcttcaacaaaatcaacaaaaataagcaatgagaaaaagacttcttattcaataagtggtgctgggatagctggctagccatatgcagaagaatgaaactggactccttccttacaccatatacaaaaagtaactcaaaatggattaaatatttaaatgtaagacctcaaactataataatcctagaagaaaaccttggaaacaccattctggacattggttttggcaataatttatgactaagtcttcaaaagcaactgcaacaaaaacaaaaattgacaagaaggacctaattaaactcaagagcttctgctcagcaagagaaactattatatcaacagagtaaacagacaacctagagaataagagaaagtactcacaaactatacatctgacaaaagtctaatatccagaatctttaaggaacttaagcaactgaacaagcaaaaaacaaatgaccctattaaaaagtgggcaacagacatgaacagatatttctcaaaaggacacacaagcagtcaacaaacatatgaaaaattgctccacatcattaatcaccagagaaatgcaaatcaaaaccacgacgagataccatctcacactagtcggaatgactattattaaaaagtcaaaaaataacagatgttcgtgaggctattgagagaagggaacacttatgcatatttggtggcaatgtaaattaattcaacttctatggaaagcggtttggagatttctcaatgaatttaaagcagaactaccatttgacgcagtaatctcattactgggtatatatccaaaagaaaaaaaaattattctaccaaaaaaaaaaaaaaaacccacttacactcatatgttcattgcaacactactcacaatagcaaatacatgggatcaacctaggtgcctatcaatatagtggatcagataaagaaaatgtgacacatatacaccatgcaatattttgcagccataaaatagaatgaaatcatgtcctttgcagcaagcaatatggatgcagctggaggccattatcctaagtgaattaatgcaggaatggaaaaccaaatatttatattctcacttataagtgagagatgaacattgggtattcatggacataaaaatgacaactatagacactggacactaaaagagaggagggtgggaccagggtaagtgttgaaaaactaactgttgttttctatgctcacaatctgggagacgggatcattcatattccaaacctcagcatcacacaatatactcatgtaatggacctgcacatgtacccccttaatctaaaacaaaagttgaaattacattaaaaaagaaaacacatacacaaaaaataaaatgtacttcttcctttaataaatttatcaagagtatttcaccttgatgtagaaatgtaaaaataaaactgataaaaataataccaatccaattaagcaaatcagtgtgtccatgtctataaaatcctccctacacaactgtcatcagagagtatatgttttatcagttacagcgaaagtatgataggtgagtctggagggcagatcaattgcattgctttgataagctgtatcgttttcttgaacgtccttcccacccactttgcagccactgccatctaccgtaaaataatcaaaaatgaaatttccttgttgtattgtctaagtttatgcttccacataccctgctttttattttatgatactaaaaatagaatttgaagatcagcagaaaacatgatgttattaattcaacaatgtattttgcaatgtaatcactgtaaaacttagatttggaatctaacatatatactggtttaacccatgattatggggaaagttctaagcaaattttgagggagagataatgtagaaagatggtgtatgaaaattcaaggaatatgagactttagagcttttatttatttatttttaaaaagagatatagcaaatgaagacataagttcagaagttaatattctaggcagaaaaaagaaggaaataaagaaaataaatatagtaaaaacttgacaatcttgggtgaacacaaaataaaatatgtctttatttttttaaaccaaattaaattcgatgctaagctcttgttcatcagggctgcagggaagttactggggctgctgttttccctgggctttagcaaagatccaggggtctaacatacagtgaggaactcattgatgttcttctggttttcagcaccagatgatgttcttctggtctcagctttctctgagatactttgattccagcccctcatgaacccttgaaaacagccaactccatggcatcctgttcattcctgtacacaaaaatgttgctccagggctgggaggcctagggctgtggtccagctttcccaggttaccatgcagccattgcctctgaattcctctctcccagcacaatatcatcaatgagccaaggtttattttaaaagaaggtatactgtcttcatccactgagattatattcttgcccagttatcttcttggaagaggcacaggaaaaaaatatctagagtgaaatgcaaatcttaacaataaaaatgaagcaaaaataaaaataaatatcctaataaagcttattggctcatagaattttgaaatatctcagtagaaacaaaacagaactatctaggagcagaagaaaggaagcaatggtgggatggggaagaagcaacaaagaagagaaagtatatgtcattatggaaaataatggagggaaggatatagatagggaaaagatagggaagttttaactgaattttataaagaaacataaagttttatcttacctaccttaatgtaatttgttttccccacagcaattatagtacagaaaaatgataattccaaaatatttaagtaattataaatttctaatcttacagagctcttttaaaattactttcatttgcacatcacaatacagtttagagtagatatattagccagaaaacaatttctccattcaagaatttgatgcatctataagttttttttattattagaagtattaccttactattgcaaatgttgatatcatagtagacaggcaaacaagtgatcttaatgctggtctaaaagagaaactaaaatatatttttaaaaggtattaaaaatatctaaaagacattatcatggaggccacatgtatatatttagaggatgaatatgaggcataatattttggtctatagtttgggttttagtttccattatatagggactaaaagtaatgtattatgaaagattggaaagaaatgaaaaatagatgcccttgaaaactgttagatgactcagcaagacgcctcagtgatgatggaagatgcacatgaatgatgtagaagagaaacatgaagaattgagcacaattgcttcatgaaatctaagagtacgaaaaagcaatatttcaaactcttttcttttaaaaacataggttttcatttgtttgtttgttttgtttgtttgtttttgagacagaatcttactttgttgcccaggctggagtgcagtggcctgatctcggctcattgcaacctccacttcctggcttcaagccattctcctgcctcagccttctgagtagctgggactacaggcatctaccaccatgctcggctaatttttgtatttttagtagagatggggtttcaccatgttggctagactggtctagaactcctgacctcaagtgatctgcccgccttgacctcccaaagtgctgggattacaggtcgtgagccactatgcccagcctaaaaatgtaattttaaatatatgtgtgtaactaaattgatatattaagtattataagtagggttttgactcttctaaaattttatttactttttaagcttattttggagcaaaattaaataagattttttgggtatgggttttcttgcattcacacatctaaactaattggaattagaagttcatgtgcacctgaaaacctgaatacagtggaacctcagagaattcaaaatttaaagcaggagttcttaaatgagaaagtattagggaatctgttaattccctgtaacatatgtgaaacatgacttgaacacctatgcatatgtgcatgttttctggtgtgaagagactacatagctctttctcaaaagtatctcaacccttaagttaatcaagagacagtgctccaaacattgtaagttgaggggtatggtcgccagacttcctgcaggggcaagagaaaagtggggatagaatgtgcttgaatgctaatgtggccacagattgtatctccaccaaaagcaaagagtctaaagaaatattcaaagagctaatctggaaagatattgaaatacatattggagaaaatcagtgagaactagttacaaaaatttctaagaaatggtggctgttgcaatgaggtaagtagctgcattcctggtgttttgttcagaacagagcacttgctataagaaccatgaagaatcctcgaaataagaaacagtaagcttttctaggttgtggttgtgtgtaagggtgtcaagcaagtgactggaagttcaaccaggactgcagccccagaagaggccttgcctttcatcagagacggatgccaattaggtagactaggtgtaggtgccatggacacattccaggctcagattggtacatcctgcttgtctgaattgtaattaactcaagaactaggcaagataaagcttgtagctaaacaagactgaagaaaggcatggaactggttaatgtatggttctgtagaccaaagccttgaactccaatcaattagctgatgacatgatgactctaggttatacttgtttataagaagcagagattttcttattgccctaattatacttcattttgcttgttgatgtcttggccttgctgtttacttgtgatgaatagataaaataaataaacctgggtatcattgacatgtacttttttattacttaagaagataatttcagaccactagaataaatgatgaatccaaatgccagtgcatctttaggctatcattatattctatattgtgtaactatccactttcttttacaggaaaaagcaaatattacaaattaatatagataacaagcaactaattccatcatcaaatccttataatcactgaatatttgggtttgaaagtaaatataaaaagataagctttactgagatacaatgatgcaaaagtattactatagttaatgggaaaaaaatattgaattatttgactatcctactggaaatttcccttgagaaatggcttaatggtcataaaattacttctgttaggccgtaaatatttcattttcctaattaaaaatgcatgtatgaactagagagtatcacaatttatagctatatctggccaccagtttctcagaaatgtatttaacatagtcatttttcatgccttattttttccccctgtactttgagattaaatctccaaaaattctctgagagtcatgttaatactggctttcatttttgagtgaagaaaaggaggaagccaacattgtttcttataaatttgatttaaatagttaagcagccagttaagagattccagattcactgggatctcatctatgatgtgtattttatttacagggtaggaaatttcattttcctatgcttaacgtctgaaatactattattacatgaaggtatgctatatttcataaatggtttctgttttctaatgctgcatgagatttctatttttttttcttatctctttttgagttgaggatactgaacaaaaaatctacgctgggttctgtttaaattattagatcactgaaattctcagaaacattaacctgaaatacagtaattcaaataaacattagatactaaaggagaacgtttctttaaagcataatgtggtaagtggcaaccacaaatggtttagagtgtaagcatgcatacttttaccggggtgtgtatgaattctgagcttgtctctaatttattaataagaaaacactttacatgggtgggtgtgcacaaaggaaatgacgtagaaggaggaatgacaagatgttgcttcaggatatctgctagtaatatagtgtcaagaatggcttgatgataaaaataaaatggcttgaggaaaacaatccttgttttccctgtatcattaaagtcatgaatcactgggctcattagagcaaagaagctattgtaagaatctagaaggaaaagagttggaggagtttaaaagaaaagcaaaagaaacaagaggaaaaaaaggcaatggaaggtttcgggagggagaagagtagtaaattgcctctagttctggttcctggaagagaagcaggacccatagtggcaggcacttttgaagagtagcccagactctttaagaagtaaatttcacaatggacagtgagaggcaggatactgttttaggctgggggtatttgaagattcataatggccattcgcattacataaaatttgattaagatatttttgtgataattaggaaaatgtaataatggcttagaatgttggataatgtatttgggttgatgatgatgtcttaggattggtgctggtgttgtagttatataggaaaataatcttcattttgggaggattcattctgaagtatttagtggtgaaatgtcaagatacatattgactacttttaaatgctttgacaaaagagaagtatgtgctatgtacagaggagatggagcagttgtgacaatttttacatctttgaatgtaatagaaagacatatgattgttatgctcttctgcttttgctgagtttgaacattttggaataaactaaaaataaataaataacaccgtatcccatgaacaacaaacaaaaggtgctggagaagatagtatagtgagatcacatatttattgttgcttccttttgtgaccgcattgaaataaaaatgaaatgaatgtaaggaaaatgtctgcatattactaacttctagaatcagaaagtgcatggaaaaggggtgcttaatgatgtgtagaggaggaagtcacacctagaatgtgcatgaaggggagacctactctgtctggagatcctctggactcaattaccatggagggtagaaataggaggagagactttaaatctttccacttttcatgtaagaattaccccaaactcagcacttactgacaagcagaactattagggaactactctgaaaagaaataaaaataataagtatgattagttaatgctggtacttcaaaatggagccctaattattctggcattcgagattctctagcataagagctctctccctccccgttatccataaagcaaatgcaccaattaattcctgcttacatattcagaactctccatcaataatctagtgttacagtaactacaaacagaaaatcaagaatcactatatatttgatgagtgcttgcaaaatgaaaaagtacaaaaataaacacattttaaagattactttggaggacaaagaaaattcataaaacaaaagaagattaaaaataaataaggaaacaaacaacaaatcccaaatatttaatatttactcttagagagattcaaggagaattatattcttaaaataagaacaaaatggaatgaaaagaaagagtcagaaatacaagagcccttaaacattaaaacatgagtattatattaatatattaacgttaatgttgaaagataaagtcaatggaattatcgaggaagtcaccctaagaagtccagcatgttagtgactggtattctagaaagagaaaatgatgagagaatactatcaaagagatattaatattactactaatggtaataatattactgataatactcacattgcaactgataatactaatattacaaccaataatgcaaattgtgcatcccaaatacaaaaaatctgaaatctgaagtgctcccaaatccaaaactttttgaccactgacatcatgctcaaagaaaatgctcactggagcatttcagatttcggatttttgaatttgggatgctcaaccagtataatgcaaatattctcagattcaaaaaagatcccaaatcaaaaacagtctggtcatcagcattttggataacgaatactcaacctgtaataacaataataatatgttgccctactggttaacaaatatattaactaatttaattctctcatcagaaaagttttaaacaattacctgtggcttgaaggcagtacagtggtagtatgatgccagagtgtatgcccttaaccattactgaaaaacattagtcattaagttgacaggaccattaagtgcttaggccagtaattttaagcagtccaagaggacaaaaaaaatggtaaaatttcataacatcaaggaaaaatgacaaacctgtaagtttccaaagatggagaagaaaaatcaacaacagctagtcagctaaaatggaaaaagtaatcagaaaggtattatatttcttagtacttaaccctaatgttggaagacaacattcaaagttctgagaaaaaaagtacttctggacttagaattttatacttagtcaaaattttacatatgagtaagagaaaataaatagatttttagacattcaaggactgtagtatttaccctttcttaggaagtttcattagaatgtattccagcaatataaaaaaagatatatctgacaaaggacagcaatatgagggaatgatatatcttcaaatatttaaaagaattctgaagaattcttacaactcaataataagataatcaacccaattaaaaatgagcaaaagaattttaaacaggtacttcacaaaaggagatctacaaatgaccaatgagcatataaaagcatataaacatcattcattattagggaaatataaaataaaaatggctgtgacttaccattacatacccaatagaatggctgcaattaaaatagtgacaatatcaagttttggcaaggtggtagagcaattagaactctcatatttgctagctgggttgtaaaatggtacaactactttggaaaacagttttggcagctttgtattaaaaaaaatgcagtcccacaagtctactttagctttttaaccaagataaacgcaaacctatgtcattacaaagaattatacatgactgttcattgagcattattataacagtcctaaagtagaaacattaacaggtgaaattgataaacaaattgtgatacagccatataactggacaaactactgatacaggaacaacacagttagatctcaaagatagtatactaagtggaaaaggacagacacacaagaatatgcatggtataattgcatttatatgaaattatagaaaaggaacctctaatctgtagtaaaaggaagtaattctatcttgcaggaggtgcaagggattgaaatcgagtgtgcataagggaatttttctgtgtgatgttgtgggtggtggacatttgccagctttatatatttgccaaaacttgttgaactgtgctaaagtggatacattgttgtatgtaaattatatttcaatagagttgattttaaaaaagaggaaagcatgagattcaggaaggaatatattccttcaaatattagttaagggaagtcccagaatggcaattgtatagacttggaaaacagtcaaaattggagcagagagatggagggttcttcaggaatttgtctagaaaaaagtgtaataactagaaaagaaatatgactaagtacttgaaaaattttttatttatttgatttttttgttttaagttctggggtatatgtgcaggatgtgcaggtttgtgcaaaaatttaataatgtgcagaatgcagttagtgggctgtaaaaaaaaaaagaaagaaaaaactcatccaactgaatttaatgttaagtacattctccactgaatggctcaactatgtaaacattgtatgatgatgttaatactgcatattcaactttagaggatcatttttaaaaatcttgacaatgccaaaacaaatgcaaagctgacataggttgagaggtagaaacagttgagtagaaatgaaaccaagaggtaaagactattgttgataaacaagaaatgaaggttcaagtatgttttttgaagctgttgaggttaccagtagaaggaatgagaataatgttcactatttggggtggaaaggaaaggggcagcgggagatatttaaataaaataatccctagctattataacaatcaatagaaaatgtctacgttttttaaatcaagaaatagcagagtaagtgaactgggttgaatagtgtcctccaaaatttatgtgtacccagaacctcggagtgactttatttgggtctttatctgcagagtctttgccaatgtaagtaagttaaaatgagggccgggcgcgctggctcacgcctgtaatcccagcactttggggggccgaggcgggcggatcacgaggtcaggagattgagaccattctggctaacatggtgaaaccccgtctctactaaaaatacaaaaaattagtggggcgtggtggcgtgcgcctgtagtcccagctactccagaggctgaggcaggagaatggcgtgaacccgagaggcggagcttgcagtgagctgagatcatgccgctgcactccagcctgggcgacggtgggagattccgtcttaaaaaaaaaaaaaaaaatcatgttggactagggtgggccttacatccagtgaatgatttccccacaagaagaccctgtgaaaacacagacacacagaagacacacacagaggaaagtcagtctgtaaagatggaggcagaaattggagtgatggaattggagggtagggagaggcaaacaaggatatttttccttagagccttcagtggggagcatgaccttgccaaaacttgatttttggatttacagcttccaaaactgtgaaagaatgaatttctgttattttaaacctcctggtttatgtaatttgtcatagcagccctagacaactaatatagtaatcataaatatgttttttaaatagatatgagagtaaccacaagaagaaacaaaaccagttaaaagtcactgctactgggaagagcatttgtaaggagggagtgatagaacagatttctcttatttttcttcatcaaattatctgcacttgaaattgaatacttcaatgtattactgaattagaaatttttttaaaagtagctaaattaaaaagtttccaggtcaaacataagtgtgtggataattaggtagggagtttagatgactgaaaataggtcaaattcaatgtgaacacaaagatttgaacttcatataggactacgtatcccaaagggcacaattgtgtgaggtgataggtctagtaaaagactcaataactaagttgaattgctctaaagactcgttttgtaataataaaaagaactgaccttgatttatgttactaagcgtataatgtggtaatgtctcctctctaagaaacaaatgaaaggccaaagttctgagatctccctcccttatgattcagctcttttacagaggaaataaaaagaattgaaagtaggaggagagtgcctagtgtttaagcacatggaggaatcagcctaagtaatgttctttttgcctttgctggctccaaaagagtctgtagagattgtagatgtctcctgtctaggagtttcctcaccttgattttgctccacctcagaacgtttccaataatcgcaaacccaagtcagtttcaaatggctttacatgaatcagaaagtgaatgactgatatatacatgtgaggtagatacatgtataaaaattagtagctgatgggtgacagaatcactgactaagcctgattaccaccagagattctgattcaataggtatgagatggaggcagagaagctgtatttttttttaaatgtcataagccatatacaagtaaccaaagaacagattttaactgtcgttttgttttttttttgtttgtttgtttgttttttgagacagagtctctctctattgcccaggctggactacaatggtgcaatctcagctcactgcaacctccgcctcccccgttcaagtgattctcctgcctcagcctcccaagtagctgggattacaggtgcctgccaccatgtccagctaattttttctatttttagtagagacggggtttcgccatgttggccaggctggtattgaactcctgacctcaggtgatctgcctgccttagcctcccaaagtgctgggattacaggtatgagccaccacgcccgaactttaattcagtctttatcagtcctgcaactccaggcaagagctctgcttcagttctctcacttttggaaaatcagccaatccctaaactgctcgcttcccccaagtgtgacatattaataaattggcttttggctttgctcagagggactgtgttctccaagcacggttttcccttagcaagtaagaaattcaactttgtaatagatactatgagaggtgtagtcacttcccctgacaatcgtcaaatgattctgacctctgccttcatgttttttccagagttgaaatgtagtgcagaatcacctagacaaatggtctccaagccaagcccgttttcctttcctgattttgattcaatggactcactttacactcccatgtggtagctgcccagggttggtctcagcacctatctctttacatggcaaaccttgtgttggtacatggagaaatgagagaaataaggacaatattcataaatcaggtcaagtttattgaagtaaataaaaatgatccccagagtgtgtaatataaggggttattttctggaaaaattctatgaaaccatcacatttacaaggtattgaaagttaagcattgaatacaaaattcaagggatttgttgaaagaaaatattttttcttaaagcataacttaaaaccgtgcattgttttgtaagtagaaaatgtccttaaaagcatttagagaaattggactttatcaaaattaaaaacttttgctcagtgaaagatcctgttaaaagaatgaaaaggcaagcaacagactgggagaaaaaatatatttgacaaaagtcttgtatctagaatatgtaattttgaaatgactttcaaaattcaacattaattcaaaaaaactcatttagaaaatgggcaaaagataggaataaatgtttcaccaaaaaggatatacagatggcaaataagcacatgaaaagatgttcatcactagccattagaaaaatgcacgttaaaaccacagtgagatatcaccacacacctatcggaatggttaaaatcaaacagtggcccaccaaatgctggtgagattgcagagtaccaggatcattcacgcatcactggcaggacagtaccaatgacataggcgttctggaaaatagtttagtagtttcttttaaagctgaaagtggatgtgccatagagcccagccattttcctcatgggtatatatcctagagaaatgaaaacttattttcacatagaaactgatacgtgaatgttcagctttatttgtaatagcctaatactggaaactacccgaatgttcttcaataggttaatggttatagaaactgtggtacatccgtattatggaatactaatcagcaataaaaagaaatggtctgttgatacatataataatctctatgaacttctagaaaattatgctgaatgagaaaagccaatctgaaaaagttacgtactacatggtttactcatataataattgctaaatgacataattacagctctgtgccccaaaacaatgattcgatcagtgatggactgcatatatgatggtggtcccataagattataatggacttgaaaaattcctgtcacctactgtcatcatagccatggtattgtcatagtgcaatgcctttactcacctgttttttggtgatgggggtgtaaacaaacctactgctctgccaatcctatgaaagtctagcacatacaattacgtacagtatataatacttgataatgataataaagaactatgttactgctttctgtatttgctacagtatatttttgtggttattttagagtgtactccttgtacctatttaaaaaaaggtaactgtaaaactgcctgaggcaaggccttcagaagttattccagaaggtcttgttatcataggagatgacagctccatgcacgctatcgtgtattgtgtattggacagtatgttctagtctttcacattcactcaccactcactcatgacttacctaaggcaacttccagtcctgcaagttccatttgtggtaattgacctctacaggtgtacaattttttatcttttatatcatattttcactgtaccttttctatgtttaaatatatttagatgcacaaatacttaccattgtgttacaactgcctacagtattcggcacagtaacatactacacaggtttgtatcctggaagtaataggctgtacatatatagcctagatgtgtagaaaactatagcatctaggattgtgtatgcacactctatgatgttcacgcaatgacaaaatctccaaatgacacatttctcagaacatattctcgttttaagtgacatatgactgtgtataaagagagagaacagattagtagttgccagggtttaaggatgagggtggtgggtgtggctataaagggtaacacaggggcgttttgtggtgaaggaactgctttctatcttgactgtagtgatggatgcatgaatctacacacatgctaaaagtgcatagaaccaaatacatacacacacaagtgcatgtataactggcaaaatctgaataagctctatggtttgtaccaatgcgaatttataataatattgtactatagttatgtaacatgttaacactggggtaaggtttatgcacccgaagggcacacatgatctttctgtccatttctttgcaacttcctgtgaatcgataattattttattttattttattttatttagacggaggagtctcgctttgtcgcccagggtggagtgcagtggcatgatctgaactcactgcaacctctgcctcctgggttcaagtgattcttctgcctcagcctcccaagtagctgggattacaggtgtgtgccaccaggcccagctaagtttttttgtatttttagtagagatggggtttcaccatgttggccagactggtcttgaactcctgacctcaggtgatcaggtggccttccaaagtgctgggattacaggcgtgagccaccctgcccggtgtataatcattttaaaataagaagctaaacattaatgatgtagctcgtttcaaagtctgagaagtcatttataattattggaaattaattaatccatgtttaaaatgtattgctttgggcaggttatgattcagtagcttaaaaaaataatccattacctctcaaaaaataccactccgaaaaactgaaagatagacatcagctggtagagatcttataacatagatcaaatatattagaaaataaattttaaaaaaaataaacagttcaaggtaatagtataaaataaaatattattatttttgtctatccaaaacttaaaagaaaatattttgatttagacatcttggttgccaaatatcttctcagaaaccactatctgttattgtagattgtatctttgcaaattcaaaattttactttaaggcagagtctccctctgtcacccaggctggtgtgcagtggcacaatctcggctcactgcaacctctgcctcccaggttcaagcgattctcctgcctcagcctcccgagtagttgggactacaggcgcgtgccaccacgcatggctaattttttgtatctttagtagagacagggtttcaccatgttagccaggatggtctctatgtcctgacctcatgatctgcccgccttggcctcccaaagtgctgggattacaggcgtgagccaccacacccggcccaaaaattttaaatattttattttttgtttgatttttattccaatttagttttttaaaaacatagtttaaaaaataatttttattaaaattcaaaaatcaggaaactgctgctctatctagtgcacgtaaaatataatttttttttttttttttgagacggagtcttgctctgtcgcccaggctggagtgcagtggtgcgatctcggctcactgcaagctctgcctcctgggttcatgccattctactgcttcagccttccgcgtagctggg

SEQ ID NO: 3142 - DNA, 2137 bp, Homo sapiens
gtcactggaaatcagccggcctcagaaagtgtgtttgtgtccatttctcccagcgcaccctctgcatatctctacccacttgtacataattcagcatccagcagaggaaaacaaagtgttgcgtacagttcctctactagcagcatgcctcccccaggacaagtgtaaagtgaagatcggtcgtcgcttcagtgaagaaagagatcctgaactttcaactgtttgccggaagtctggtacattaatattatatccaggggctgaagctgctaatttggaagaatttatattagattctcctgtttatccttctacaatcatcatcattgatggtacatggagccaggctaaggacattttctataagaactccttgttccgacatcccaaacaggtaaactagtaattttaacagagaataaatataaatatataattaggtatattgtgtatgttttctgtgaagggatacacatagatttttatatatgaatttggtggtatttctatgtgtgaatatatagtacctagatatatgtatgcttatgtttatgagtttgaatatatatgtattttgaatatatatataaaatttcaaatttgtcatttcttctctcctactgccaaattttactgtagttgaggcatttggctatattaagagtctcttagacatttaatcagagaagtctaaggattatttttatatgtattaatgtgttttgttaagaagcattatcttatttaaatactattatttggttactgaattacctagttcttactaggaatgactaagtttttattaaatactttttgtcattcattattacagttatatggtttattcttcagttttttgatgtaattaattatgaagacacctttcttaatattggtccattcttatattcctggaatggactcaactgagtaaactattaaacatttttgatatattgctgaaaattatattttatttagtggcattgaattatgtgtatttttggtccactgtcatgtttggttattaaaataatgttaacttccaaagtaaattggagagattttaatatttttctatgacctggaatagtttaaataatactagaattccttgcaccttagaaattagatggaactcattggtgaaatcacttggttctgttctctttaaaaatggtagcttttaaattcttctttcaaactcttctaaggaaattattcaagctttctacttctatttagatcagtttttaataacttttatatttctctagggaattatctcttttctctaagttagcagattggttgccatatacttatatacagtcttaaataattattttaattactcaggaatgcatttttttcttgtttttaatcatacacacacagacatagacacacacacatacacaaacgttttttacacaaacagattcaaaaggggtttctctattttatagaacttttaaaatataagcttttaggttgtttatattggctattatagtttatttttatttcattacgttgaacttttttctcgaccaattttatatttcatctttttgggcttattttcttctattattcttctgattttataagatttttactaagagtacttctgtagactgaattgtgttccctgtccctcccccgaccccatgcatatattggagccctaacttccaatataatggtatttggagatgggacctttgggaggtgattagattatgaaggcagagccctcatgatgggattagtacctttagaagaagagacatgagagatacttcctttttgctctctgtctctctccgtctctctttgtctctctctctctctttctctgtctctctctgcatgtgaggacacagcaagaagacttccatttgcaagccaggaagagagctctcaccaggaccgtgaccatgcaggtgcaattaaaaactagcatttctagtcagtatgtaattcggatgcagccgactaatagatgcctttctacactggagtgtgcagctgttgctctttccatcttggagaaaaataattacatacaagaggtatgtttcctgggttcagtgtttcagaatacagtccactgtggtgactctgtaaa

SEQ ID NO: 3143 - DNA, 8849 bp, Homo sapiens
gttaacatctgcccagcataaggcctccagcaaactaaggcaatgctggggctctgcctattctcagtggttgatgccatttttaaatataaatttttttggtcattcttacccacagaaggactttacagcaagaatagaagcaagctgaggtgtatgccagatgacatgacaggtgctaatgatagagatcaaagtggaaggaaaggagtgaattctccctccaggtgccatagatgacatctttttagatggatcttttgtttcgcctttaaggtaagaaatgaaaggggtggctgatgcatttagatgaaacacaaacaagcatgtttgattgtttgatttgtttgaaaagttgtcagctttataaccatgtggctgattttcttgaaggacagagcctatacctgcccctctgcctagccctacctacaaccaaatgaacactttaagtagcctccatgctctgtgggtggttgccttaggatttgatttccttcctgcataactgttagggaaacacattttctcagaaataaatccccaccataagtgtatatatgagttgagcctgtaaagttatgagatgggatttttcttgtggtttgtggaatcagttttagaagctgaggaaacaacggaggtgatttaggctgcccagatggataagttgtaagagaatttatgtgatgctgagatatgtgatagagttgagatgatgtaaatgaagagattttggaaagtagaaagcactacataaagatattccaactcagagtggttaataatcactatgttattcagcacattgactaggaattaaattattttatataagccttgtatttcaggttaaatgttatccaagagagcattttaggaagtgatttctatttcatctggagtagtcttctggttttcattatgattttaatattattgacaatgcatatttgttttagctgaggaggatgtacacagtgtaacttgtacctttttccagagctgttgcaatgttctacaggcaagcattaattcaactttgctaatggatataaaggcacagaaaagttgagagtgcttcttgatgtcacacagcaaggcagcagcaggataaggttaggacacagaagccttgaccttcagttatgtgctcacaactcttgaacattccctcttttactgaacattttaaaatgttgtatttatacttcaataagggcctaattaaataaattagagctcaattttcagcttataaattcttctgaactgaactccaagtagagccaggaaatgatcacactagctaatagatacagcataaggaatcatgctattgtgcttattaatatatggctgacaatgaagataatcacaagtttatttatttacttttcattaaaagtttctcatataactctgtaataccagatattggtatattcatattctgggaacacatacgtttaagtgtcattctgctttttagcaatgatttttaatgtccaaatgcccagatatttctttgggatgtgcgttcagaatcttgaaaagtgaatttgtaggtagttgtgaacatggaagtaaggtagcattgggagttgatgtctgaggaaggtatctttaggaaaatggcatcaccaactctggctgcaaatatatttttattgttgcttgtgatgcaattgtcctggacagaaggaatttctatttacactcaccaaagagactgtagcagagaataacaggggtactgagtactaactaaccaagagatcttatttgtatttatttatttacttacttacttatttgtgggcaactggcatagtttgttatcctgtagggaagttctgtcagttatcaatgtgtttgctctactttcatgaatgagtatacaacattcaaagcattcaaaattaacatggccatttttatattattattcgtttaagaataaaaacaataaagtaaaataacaataatgaattgatgtcactgacactatttggcagggatggggtggggcaagaacccatctggttgaatgagggtaatgttacattattactttgaaatattaacagaaaagtttgggggataattaggtacacactgcagaaaactctctggattctataaacaactatatgttatactactttgaagcatcttgcattatatttgtcattgaggaagaggaaattattataaattatgtgtttataactttaaaatagcttcaaacacaactagtaatgatataagtaaactaagctgaaataaaataaaattgtatatttacatacatgcatacatacatatatttcttctcttaggttgagtcatctttttgaaatgttaccttctaaatcatactaagaacagcatatctttaggttatggtttattcttaggaaagttacaagttacattggttttaaaaatataatattcccttttcttcataatcatttcacttccactagctaataataccaaagtatataaatgcccatgtttcaatccttaaaatactgttgcctcaaatgaactccaaaatatacacatgtctatgctatcaatcaaagatgaaaatgttggtattgataggccctactccaatgtatttgaaacttatcacaattacatttttaaggtgtttgcatctcattgaacacttgcattctaatcaatagtctctcaaaacgtgtcaacagtattgatatgtattttggtcctacgtgctgctcggaatttgggaagcacttatttgactgtgaaatggcaaattggtgcggttacttttgtgaaccttttcgtatgccttctcatttccaatacaacaaatgcttgtatgtcacacctgatgtagcgaaagatccaaataagactctttaagttttcaatgtgactgtcatgaacataataatgtgttattctttctgcttcattcacaactctgtagattgagggatcagaatttagctggacaagatgcatacaatatatgagaacacaatttaatttgtactacattgactctacactgctgactaaaaaaaaaaaaaatcaactgattcacatgttaaattcatttatccaaaataaaaatgcacagtgaggccaaaagaaaaaaaatgcttaaaaaagattcaaaacgttaaacaaattgcttttaattataataaaaactgcccaggttcctctaacttgtcacttcaaacataattattaaggtcatctgtgctgcctaaagaagaaaagtatatcaaaattactgagatcagctcctgaattgagcatgaaaacttagactctgactgtccaaccaaactagccaattctgaaagaatgccaaaatcagttgagagcaacaattaattaaacaaatatttgaacaagtactaaaaactcttcttttggatggattttttcatattgttataatggtagggttcttgatacaaccttagtttctgatttttctaaatatgctagtgagcactatggctttgcaaaacccagtatccatcacataccaaggaggtataaatccttggtccccacctaggatgtagactatcctcaagaaccagagctatgaatcccagtgcatttttagatgaggtggaggtggctatgcagcaatcctgatggtttgatgcactactcacctttgatgtcaaaccctacatattagctaaggtatttcatcaaatgctccaactttaatggattttctccctttccaagacaagttttgagaataacatcttctgttttgcaaaagcctggataggtttaaaaaatatccatttgcttatgttagctttttgcttttcatagcaaattctctatggcaagtatatcatctagatgactctgagtgtatgagtgtgtgtgtgcgagtgtgtgtgcgcatgtgtctgtgtgaatgtgtgtatgctcacagacagatattttaaattactcttttcctcaaattctaagaaatcagaagattaaatgatttaattatatagcctcctatttccccaaatcttataaaatgtcaacatctcctatttggtctttgcaaacttgatctctctcatccttaacccatttatgaacatgtctattttgcttggaccttttggagctgaccatagtcacacaaagaacctgtttcttcggttagacatgcttttttacatgctggtaattattaggtgataagagattaaattagagaagtaaaaagatgaagtttggctagaaaggtgttttgttctgtttatttattttaattttatggaaattaaaaggtaccaacgactcatttcgtgctccttaacattgtggactgccttactggagggttttcccttgttctcacattacacacatgcacatacacgcacacacacacaaactagatgctcagttactatttatagactatcatctgccagggtctttgaaatttctgttttgcattaaagacaaagaattcctctttctgactgctcattgagggtttcctgatacaagaacataattaactctttgctggcctaactaatttctgcattttaaaaagtagccagatatgacaaaagtggagcactcaatccacagggtggccattaactgcactccgttactgtatgttctcaattcagaccacaattactgtcagggaattgcactggaagctccttcttgtacgcaaacaggaatactattcattaaagagcactttcaataaaatacaatctatattttttaatgaatatttgagaaagaaaatacaatcttgggttcagaaacctgcaatatggttattattcttttaataacatagactttctcatgtacatatactgacagatgtagaagaaggaagcagaaatgagatggcgggctttaactcagaaaaaatgaaaaagacgagccacagtaaactaagtcaatgttaaataaggatttcctcaaccacctacagcagacacagctttctatgggttttattgatgtccctgggacagtagattccacttaaatctttcaagcccagttaaatatgagaacatgaggcacttcagagactgaaagaaccaagaagcccatcaaagactatctcctgctctaaggatttgccactccacaccaaattcttttccctgttaatgtatttttaattttagtgactgtagttttcatattttcagactgttggttctgatgaaacacctagttgcagtccctaggaaatgcttaatgcccaaaattgcctacaattatttccttttaatgaactttaaatatgagtcagtactaaaaaaaaaaacaaagacagaaatagcagtgtgtgtgtgcatacacacatttataggtacacacacatatgtatatacacatatatatacacacatatatttgtaaaaaaaaataggctagtaggctttttaaatgcaagagtagtttgctctgatagcactcctttggtagtccagctacattgccagttgcttcagagagcaaaagaaacactccatagactgagagtgtttcttctttgacaaaaaaaaaatgccaagaattctgctactcaaacaaaccttccattgaaaatctaaattgcgctttccagaaaacaactggattacaattctttaaggaatgaaaaataggtggaaataacctattaaagtacaataagctgccaagggggaaaatgcaacatcttaaagaaaaggcagatcactaatttagagtctcctaaagaaaactcttacataaagtcctgaattcacattgggttatatcatttaaaatcatatcatgcagcattcattccctgactctccacaaaagaaattgaatgccagttatcaagattattatcaatatcctggtattagttttgaagcatgttttaactaataagatgatgaataactgtgaagtaaattcccccaaaatgaacactgtgtttcctcccttgtgtttttagtttggttacctaggagaaccagagttcgataatacactgattgaatacttgagaatagggacatagtaaaaatatctttcaatatttcctaaagcaggttgtttctcctcttgcctatcattggcaaatggaaaaggatttagaatttcagagacagcactttgctcatgtgtgccagtcatgcatggagtgaaatgtgttaacctttaaacaatttgggagtggatgcagttaataggtaagacagatagttataaagtcctgattaactacagagcgcatagacatgtggaaacttgtatatgggtgaaagggaagagacagcaaagattatttaccgttctagagaacaggtcctggggaacagaatgaggaaattctgaacagcaacattgccctcttttggtaaaacagtgtacaatgtgtttacctcacttgcaggtgaaagcatttcttcaggacacagacattttccacatcaagaaaaatggcacaaactaaaacaaaccgcagagagggaaagagttcacctatatacctgtaaggtggacggaatttgcatacagagtaaagacacttgaagtgacaggctaacaaagaagcttttagactcagtctttctggggtccagtttcagtgactgctggattatttaacccttgtatttatccttgactgcttcaagccgtctgcgttgtaatcagaatcatgtagcactcggaatgtgaacaaataaaacaggagctagttctttttgagtccccagtgcttaaatacgcaggcagtctgcagtctgagcggaagtcactgaataaagagccgtatcccgcagaaaagacgtccccagcagtttgtgctttgtggctctaatgaagcctgcgatgatttaggacagtgaaggaaaggggcttgattgcatcaaaaaagaaaaagaaaactgtcaggacgagacacaatgttaaactaattacttttattcatgctgtaggtgccaacggcactctttaaataatactaatttcaggcttgtctccatctctaatttcctctctgttttccaagttagagtccttctctcgctggatccgtgttacgggatttttctacgtgatacttctggaacttaggagtgtctagtgcaaatgcagattcattgaaccagtttagaagattatttattatatttttctcttcctgactaggaaattaatcaccattcctgctagtcacctttgctagcttacgggctaaacatatttgaaggaagttatcagttccctttaatgatcacagtcctttcagggacgaggacaaagcaagttcatcttcttttcctcaatagtttgagaaaaattctacttcatgaaaggaaggtagcattatggtccattctttagcatttaatttattctccctaaataaaatactagtaaagagcaacgagtttctgcaagtgaaaatataactgtaaaataaataattacagtcctggagtaggaaaggtaactcagatttgtatttgtaaactgatttttcttcttcttttcattctgtgatttggaatacctggatcattatgtatatgctatcattattttcagagtagggtttgacaggacttaagagtttaatgtttaggtcacattttcttcagagtattcatttgccaaaacaatgctggaatcacttactataccaggacattgaattacataaaaattctgaaaaactcttttgagatcttttgcaatcaatttagaaaaccttaagtcggttaatgctatcagtgctaaaagtttacaaactgcgttcatataaatcatcttattttatctttacccagtaaggtacttaaagatctattattgccttcacttagcagataaggaatttggagatcagagagttaactaagagcacacagaatgttgatggtggggttggactcaaatccagagttctaaatttaatttttgtgctcttttacttttcctcatatgtgagcttgtataacttatttctctacctgcctaaaggcaaagctaatagaaatctagccccttaaagcctccaaatagcatgcagaacttgaaactaaaatgtataaaaacattttaaaaatgaaactgaagttgggccttcctattcactcctgtttagacagatttagaactccaacattatcttaatggaagcacatttttataggaaaccacattccatgaggtgaaaacaaagtttttactttctcaattccatctacagtatcagtatgcttcgaagcaacaaataaatctatccattaacatccttattctgtcactatcaaatggatgtctctcccacatccagtggcacctctctaagttgtagctatcagcctttgcaggatttgtacctgaagaaaaggaagctaatcttccaatggcaggattcgaggggcacacaggtggcaaaagcaattctataggtctgccaccaaacacaaacagcactacaggtaagccttcctagaccgtattgttcagttagaccgtattttcactgaattcccctttgaacctaaggaatttgcttactattacctgtagaagaaaatgtccttgtgcaaatttctcctggccaaaatatgcaagactttattatagtaagaaagagccagttccctatagccatctatgtctttctgcatgaatgtgttcattgacctttgaggccagcaacataattggggagtggggggaaaagaatattatttcttctaggataaaataagaaaaaaaatcagtaagtttgctgctttttacatctggaaagagaaagaaacaaatttttcctgtctctg

SEQ ID NO: 3144 - DNA, 22650 bp, Homo sapiens
attttacttgacgccattctgaatgggattgttttcttaatttctttttcaggtagctcattgttagtatatagaaatgctactgattttcgtatattggttttgtatcctgcagttttcctgaatctacttaccaattctaacagttttttttttgttttctggtggaatctttagagttttccatgtataatatcatgacatcagcaaacagtgacaatttcccttctccctttcctacttggatgctgtttatctgtctatttatctggcctaattgttctggctatgggcacatagatattttgattagccccaaaattcacagatttccaaaggagtagagtttgagtggtgaagctgattctttcactggtattttcatattttgcatgcgatggagactttcatattattatttgtcatctgagatatgacaaaccatgagggtgtggtatgaacaatatggagtactgaaatgcattaaaaaactagagcggattgatggttgcagttccacaagatcattttgggtgatttgtggaatggcaaatggaaattatgccacctcagtgcttggttcccaggctagggaaagcctgtcatagttggtattcacattactttcaaagttgaaacttcagtgctaagcaaattttggattaaaataagatattagtgggcagaagaaaatatgtcattcactgggcacttactaagtgccagacattgctctagggcttcaaggtccaatgcagtagccactagatacatgtggatattaggcacttaaaagggggctagtgtggctgaggaactgacttttaaattttgtttaatcttgattattttaaatttaaaacactgatacttggttcagtttttggaaaactttaagtacttttggaacaacctgggtatgtgaatctgttttttcaactgaaaatcttaagaaatctaaatatagatcaagcatttcctatgaaaatttagtgtccaaattaaggtgtattgtaagtgtgaaatacacactggcttttgaagacttcatagaaaaaaaatgaatgtaaaatatttcattaacataagcttttctactgattgggttttgatatgataatattttgaatatattggattaaagaaaatatgttgttataattaattttcccagtttctttttgcctttttaaaatgtggctactagaaaatgacatatgtggcttgcgtgatatttctattggacagtttctttctaggggctttgacatatgccattttaccaaatcattaaaataacccagtatggtaggcactactgttcccattactataggaaaggcaattgagtgaggctcagaaaagttatttaagtctctcaggtgttacatttcttatagagcaaagccaggattcaaagccaggtttggatagccccacttcttctttgtttctactctgttgtgttgttcctggttgctttcttttaggaaagccatgaagagcttgcagttctgtcttgattcttcgtaataaataagacctgatgaacctatttatgaacaggaggcagtttgaaacaaaaattaccttctcttcaaatggtacaatacattgtcccagtttgtgcattttgatgaagttggcagttgtgtacagttgtgtaaccaatatcacaatcaggtaatttccattacttcaaaaggttttttcttgtccacttgcagttgattacctccacagatgattactatgcacaggcagctactgatctgccctcttatcacctttatgcttgacttatttcacttagtatgatgctattacaattcacgcatgttggtgcatgtacctgcagtttgttccttttcattgctgaatatagtccttaatatggatatgtcacaatttcttttttgtactagttgaatgatatttgtgtttccagttttggcttcttaataatgctgctactatcattcatatatacataagttattttgactcaagtgacacaaaatatttatcttggataaatgtctaagataagtaaacatttaactttttataagatactgccaaaatgtttttaccaaagtgattgtatcactgtgcaaatgaaaccagcaagttatgagatactagttgttctacatcctcaccaacactttgtattgtctgcctttttaatatttgtttccagtgagtgtgtagtgatatctcattgcaatttgaatttatgtttctctaatgcctggtggtatcttttcacacatgtattggatgttgatcctctttcatgaaatgtctgtttaaatcttttgcccattaaaaaaattcaggacggtcttattattgagttctaagcattctctatatgttctagatataaactttttacctgatgtgtgttttgaaaatattttctcccagtctgtgtctggcctttttgctctcttaaccatgtttaagagctcatgtttttaaatttagatagaatgcatctagtttatttttttcttttatgtttgtattctttgtggcctgtttaagaaatatttatcttacccaatatcacaaaggttttctcctttttttcttttagacattttatgatttgggcttttactgttaggtctatgatgtatttcataatacttgtttttttttatatgttgccacaggcgggggaaaaaaaacggcttggattttgtttttttttccttgtgggacaagtagttgtttcagcaccatcttttggaaaaaacttcccttccccatataattacttaggggtaattcaattttatttattaacaaagatactttgatactccttctgagttctgtctcattgatctgtaggtcttaggtcaatatcgtactgcttttataagtgtagctttaaagtaagtcctaaaatcagacaaggtaagtattccaacttaaaaaaaatttttgcctattctaggtcttttacctttctatatgcagtttagaaccagcttattgatttcttctgagaaacttactaggataatcatgaattgttgagtctattaaaatgaaaagacattcgatctagttaggtctatattttatgattcatttttattaatctccttaatattgtgttcctcttccttctttctagctttttggagattatttgaatattttaagatatattatttatttttttcattgggttttgactatatggttgtcagtagttgtgatactgtagcatagatattcaagatgttatccattggagaaacagtgattgcaaaataaaaagtttaacctctaaaagacaatttaaaacttgaataggtagattatagactgaaagaaaacatttcaaaatatgtactggcaaatgatttgttttcaagatttataaaaaaagtcctatagttctatgataatatgccaaaatgatctgataaaaagttggcaaatgattatcagatacttcataaaagaagatccatgaataaccaacaaacataaggaaagctttccacatcatcagggaagtgggaaaggcaaattaaaaccatgatgaaataccactacatacccaccagaaaggccgaagtaaagaagattgacatcaaatattagcaaggatgtggagtaaccagaactcttagacactgtgagtaggaatgtaaaatggtacgatcattttggaaacaggaaccatcattttctataaaacaaaagatacacctaacctttgattcaaaaatttcccaaccaggtaatttcccaggagaaatgaaaatatatatctataaaaagacttataaaaatgtgcaccatagcttagccaacaatggattcaactcatgtgtctgttaataggaaaatggctaaacaaaccactgcatatctatacattagaatattgctcatcaataaaagggaacaaactattgatacacgcaacatggatgaacctcaaaaacatactgagttgaagaaacctcacacaaaaatacaggctgtaggattccatttatacaaagtactcaagcaggcaaaactaatctctagtggtatagaaaacaaaaacagtgtttgcctgagggggtgagtggtgggtgagaatagatttggatgggacctgagggaactttctctagagatgtaatgttctgtatcttgacagggtttggggttacatagttgtatatcatttgtcaaagctcaataaatgatatacttagaatttatgcatttcatcatatgcaaattttacctctaaacctataaataactgtacataaaaaatcatttagttaacattctgtgtatttgatattaaggaattattgttaatttttattgtctgttttttcagcataataacaaacaaccataacatatcagtggcatcagcaataggcatttatttcttgctcatgtgtttttgagtggcttggagtgccccttcttcaggcttttttttgttggggtggctccaaacttcagatagaaaccaggttttctccatgtatttcctatctttcttggaccagtggttatattggaggcatgtgcctctcatgtaaaagcaggaacatgtacaggtaagcccagtcatataagcacttttcaagttttgctcggatgatgtccactaacaaccctgtgatgaaagcaattcacatatattagtccattttcatactgctatgaagaaataatcaagactgggtaatttattttaaaaaagaggtttaatgggcttacagttcatggcagaaggtgaagaaggagcaaaggcatatcttacatggtggcatacaagagcgtatattttgcaggggaactgccctttataaacccatcaaatcttgggagatgcattcactatcatgagaacagcataggaacccccccccaccccatgattcaattacctcccactgggtccctcccatgacatgtggggattatgggagctacaatccaaaatgagatttgggtggggacacagccaaaccatatcactccaccccagcccctcccaaatctcatatcctcacatttcaaaaccaatcatgctttcccagcagtcccccaaagtcttcattcatttcagcattaactcaaaagtccaccatccaaagtctcatctgagacaaggcaaatcctttctgcctatgagacagtaaaatcaaaagcaaattagttacttcttagacacaatgggggtacagcactgggtaaatacacccattccaaatgggacaaattggccaaaattcaggggctacaggccccatgcaagtccaaaattcagcagggcagtcaaatcttaaaaccccaaaatgatctccttggactctgtctcacatccaggttacactgatgcaagaggtgggttaccatggtcttgggcagctccgaccctgtggctttgcagaatacagccctgcttctggcagcttttatgagctgccattgagtgtctgtggcttttccaggcacacagtacaagctgttggtggatctactattctggtgtctggaggacagtggccttctcttcagagctctactaggcagtgctccagttgggactctagggggattccaaccccacatttcccttctgcactgccctagcagagtttcttcatgagggctccatccctgcagcacacctctgtctggacatccaggtgttcccatacatcctctgaaatctaggcagagattcctaaacttcagttcttgacttctgtgcacccacaggcccaacaccacatgtatgctgccaaggcttggggcttgcaccctctgaagcaacagcctgagctgtatgttggccccttttagccatggctaagacacgggttactaggtcctgagacttcacaaaccagcaaggccctgggcctagcccaagaaatcattatttcctcctaggcctcccaggctgtgatgggagggcctgccgtgaagacctttgacatgctttggagacattttccctattgtcttggcaattaacctttggctcctttttacttctgcaaatttctagagctggcttgaatttctcctcagaaattgggtttttcttttctattgcgttgttaggctgcaaattttctgaacttttatgctctgcttcccttttaaacataagtttcaattccaaaccgtatctttgtgaataaataaaactgaatgcttttaagaacacccaaatcacctcttgaacactttgctgcttagaaatttcttcctccagataccctaaatcatctctctctagttcaaagttccacagatctctagggcaggagcaaaatgctgccagtctctttgctgaagtataacatgaatcacctttgctccagttcccaataagttcatcatctccatctgagactacctcagcctgggttttttggtcaaaaccattcgacaagtctctaggaagctccaaacatttccacatcttcctgtcttcttctgagccctccaaactgttccaacctccgcctgttacccagatgcaagttgcttccacattttggggtatcttagtagcagcaccccactcctagtaccaatttactgtattaatccattttcatactgctatgaagaaatacccgagacaggaaaatttattaatacaaaaacacaggtttaatcaactcacagttccacatggctgataaggcctcacaatcttgatggaaggtgaaggaagagcaaaggcacatctttcatggcagcaggcaagagagcatgtgcaggggaactgccatttataaagccattagatcttatgagacttattcgttatcatgagaacagcatgggaaaaacccactccttgattcagttacctcccgctagctccttcccgtgacgtgcagattatgggagcaacaattcaagatgagatttgggtggggacacagcataaacacatcatatggccaaactcagattcaagaagtagggaaatatttgatgccaaatcaaggtatggatgaataatactaataagagggggtgtgttaagaattaggacctttgatattcaatctaccgaggtgttattatagtattatgttaaagattttaaagtagtctttatttttggaaatacatgccaaaatatttaggggttaaatgatagataggtggaatttgcattaaaataatctgaagaaggagaagtgggtggaggtatagaggaaaatattggctaggagtctataatgattaaaggtagatgtgtgccctagagggttcagtataccattctttgtacttttgtatatgtttgaatttttcataataaaatattaaataataaaccaaaagaaatcatgtgtgaaatctgtcacttttatatgtgaggaaacaggttatgagagggtgtgctacttgttctttgatgagacacctagttcttgccagaatgaagctaggatccaagccaatacttttcattaatgcggtttttggtcatttatttgctaatttctctaatgtttaatactagcatctgtgcaaaatgttatggataagaagataaagctttctattcctgaaaatcccctagtctaatggttcaatgtagatctaaataattataatagaaggataggagtagagtaaagtgctgtaatgagggtatacacaaaattcatgggtacacaggagaaggcatctctaaattttattgagaaaatccaagaaggcttcatacatgaggtaatattttgaccaaaaatcgcaggaccaatgaataagccagagactgcattgtaggcagcagaagcagcccacacaaaggtgatgaggtgtaagacagcatggcattttggcactttaggggaattatatatgactcagtgtagttaaatgttaacttcagtgtatgtatcgaggggttctggggaaaacaggcaggaatgatgaggctggacttacatgctatgcaaaaagttgagacttaattatttagatcaaggttgccttgcctaattataagaatcgcctggggctctcattaaaatataggaccttaaagtcctagctctgatctaatgaatcagaacctctaggggaaagaaaagtttgggaaacatgacttgggaactactgaagaattttaagcagaggagtgatgtgttcagatttgcatgttagaaggaccaccctgacagcagtagagaggttagactggtgaaaggtaggtgtacaaagctagaggtatgaagatgaatcagatgggtgctgcaagagtcaataggagatataatgagttcctaagtcatgacagcagaaataatggttgagaggaaatgatgttacagagctaggattggtaggctccaatgagtaattgcctctagagagtaaaacaggtggattctcctttaaatgtctcacttgatgggtggtaggataatgttcctgttgactttcagacacagagttcaaggattcaggatgaggtggtatagcagactagataatgaactcattttgggtcttgtacagcctgaagtacttatcagacatataaagaaaagtatccagagggcaggtcttgatttcaagaaaaaaatgttagctacaggtagaaatttagtgagcatcaatatgaaagtcttagttaaaacgctaggtttgcattagatttctcagctagatgatgtagtttgagaatgaaagaagtcagtacccaggaaagcagcagcatttaagggagagacagaaaggagatttgtttagaaagagaaggagagggaagtattatgaaaatcaggtgggcaaataatcacaaatgagtatggaaatatgttcactggatttggcaaaaacaaaggttggtgttggccttacccagggcagtgtcagtgaaatattgaaggcagaaactatagttttgggtggagaactgagtaggagttgaagaagaagagaacaaatgtagttaactctttctagaagcttctctgggaataaagtactgttctacccttatttgagtaggaaacatttttggagaggggtgtgcttaattaaatatgttgctccttttccctggcaagacctatgattcttgacaggtgttaaggtttactggtttgcatgtttgaaagaactgataggaattccttttagtccttgtgttgaaaattcattagctagtcattcattgttaatttatggcatggatttaagagtttggagtaaatttgtatgaaagaatccaggtgtgactacagtctgtacgaaagaacacatatatattgtgttacatacttggggtgaccattcttatgttgctaacattcatatatgtttgtacacctcaggaaggatatttcctatatatttgtgtaaatttcaaaactaatgctgtactggagattcatcaggtctttcccaaatttttaaaaccaaaattttgagaggatagattagatagctagctagatagatatagatacatatttcttagagacaaggtctcattctgtcattcaggctggagtacaatggcacatcatagctcactgtaactatgaacttctgagatcaagcaattctcttccttcagcctcccaagtagctaggactacagatatgctccactgtgcctggctaacttaattttttttttttttaagagatggagtctcactatgctgcccaggctggtcttgagcttctagcctcaagggatcctcccaatttagtctcccatagtgctaggattacaggcatgagccaccacacctggcctttgagagaatactgacagtgaatttggagacaagctgtcaggaaaaacacatgttttatcttattttatttttagattcagggcatacatgtgcaggtttgttacgtggatatattgttgatgccgaggtttgggcttcaattgaacctatgcccaaatagtgaacatagtatccaataggtattttttcaacccttgtccccttccctgcctctctgcttttggagtccccagtgtctattctttccatcttcatgtccatgtaaggaaaattatgtatgttaatgttaattttctttcctccgtgattagatttttaaaagagctcttgagggtctatgataaggttttagaatgtatgtttattttaaagttccattttatatgttatctgtttaaatcataactcaagcacttctttttgaagtgcactcgtgtgccacataatgctgtttcggtcaatggcagactgcatatataacagtgatcccataagattataatggagttgaaagtgtcctgttgtctagtgatgtcataacatcatagcacaatgcattactcatgtatttgtggtgatactggtgtaaacagatctactctgctgccagtagtatacaagtctggcaataccattaagcacagtacataatacttgagaatgatgatgaacgtctgtgttactggtttagtatttacttactatactttttaccattattttagagtgtcccccatctacttatttttaagaaatttactgtaaaacagccataggttggtctttcagaagacatttcagaatacgttgttgttataggagatgacagctctgtgcatgttcttgcccctgaagacatttcagtgggacaagatatgggggtggaagacagtaatattgatgatcatgaccctgtgtaggcctaggctaatgtgtgtgtttctgtcttagtttttaacaagaaggtttaaaaagtaaaaaaataaaaatttaaaaatagtaaaaagcctatagaataagaatacaaagaaaagacattttctgtacacggaacaatgtgtttgtgttttaaaactaagttattacaaaacagtcaaaaagttaaaaaggcttataaggtaaaaaaaattatagtaagctaagtttaattttttattaaagaaagaacatttttagtgtaaatttcatgtagcctaagtgtaatgtttataaagtctacagtagtgtagtagatattcacgttcacttaccactcactcactgactcacccagagcagctttcagtcctgcaagctccattcatggtaagggtgccctatacaagtgtgccattttatatttttataccatatttttactctaccttttctgtgtttagatatacaaataccattttattacaattgcctacagtattcagcacagttacatgctgtataggtttatcgcataggagcaatggggtatgccatagagcctaggtgtgtagtaatctataccatctacgtttgcgtaaatacactctatgatgtcacacagcaactaaatcacctaatgatgcatttctcagaatgtatccccgtcgtcaagtgacccatgactgtacttgtttggttacaattgagagaatttattacttttcttcatccccatatatcttagcagacatgaagcaggattgaaaaaaaagaattctcattaaagtctattctgaaggtcgtcaacactgctgccctcctcccccttttccccacattcgtctgtgaatttgagaacatccgcaggctgacaagaatcttgggaaataaatgaaatgcagatgagttggagctgtactatcatcaagacttgttgtctcagtaaagaaatgttttaggtcagagtgtagagaagtggaccctaagaggaatgtgatgatcctttatgggaagatgattgttcctgctgtggtggctactgctgtacctgggatgggttagtggggcatgaaaaagaataagactaccacagaatggggtttggaacggagagttaagaaaatgattaaaagtttatatttgctacaatatgactattaagatgatctgaaaatgcctagaaataaataataaagtataagaaatattttctcaagtgcacagctaagcctatagaaagtaaaacaagatttttgagggtcaaagtcacaaaaaatatgaaactagactagtaactaggccataaatctgcaggtactcaaagggaattagccaatcttggtaaccaagaatctatctttaaagagtcttttggggatagaaagtaaaccttaggctgagcaatgaagagtcaagaccctcctgtataatgccagaatctcactcagtgtaagggtaggctttgaaaattctttctggcaaagggagattaaaaaattgatctgtcctggtcagagatctggatagctgaaaaaagctcaccacaccacttgtaaggtttctgcaaagtcaagcccaaggcattaacataaagaggtcctcagttgcagtgcccctcagacatttggggaaaccaaacaaaaagcctttcttggaagtaagagcccttaacttagtatggtaaagattactacagataaggccccatgaataaaaactcactaacagaaattataaaacacaaatgggtacaagccatcatgaacaagagtcagcagaatctgtaaatttcaataatcgacacccaagatttcagatactagaattattaatttcaaaatgttacatatatatggacaaaatgttgatggaaatagaaactagagctaatgacatgaaaaagaaacaaggtactatcaaaaatgacaggcaaacataatgggcatatttggataaaaaatacaaaagtaaaggaaaatatcacaaaaatgaaaagtctgatggagagtttaagcagtaaattggtcatagctaaagagagaatttgtgaactgcaaattagatctgaataaatcaccgataatgatacacagacagaggcagaatgatggaaaaatgacagaaagaataagagatggagaaaagaatgagaaagtctaatatatattcagtgagaatttagaacaaaagagtacagagtccaggagtggtaatattcaaagggataatggttgaaggtttttagaattaatgaaagatttaaatcgttaaatttagaaggtggaagaactccaagcaggataaatacaactgcagaatacgagagataaagaaatgtttgagacaacttaggaagaaaagacgaattacctacaaaggaataactgactgaaaacagacttttgagtagcaacaatagaaaccagaaaacagtataatagtattttcaaagatccatcaaggaaaatttaattccagcataactattactgacaaacaagttgaaacacagcatttctggacaaagaaaaattgagcatttaataccaacagacatgtactaaaggaacaaaaggaacattgtaggatatacagcaaacttcgggatgaagagaactgaatccacaaggaaggacagagatgcaaaatggagtaatgaacaaatagattgggaaatcatataagtaaatgtgatcaaacattggctggataaaacaactaagaccatcacagtgaccaattgtgaaaaaaacattataatgaaaaatctggattagaatgcaaaagggagtaattaagtgttctgagagcttttgatcatttgggaagagacagtgagcttaactttagtttgtgttatgtgagaatgcatgttgaaattttaaggtaactcctaaaataatagaagtatttgataatacttttaatgtgctagagggaaatatgtaataaacatgccagtgaattcaaaatgaggcacaagatgaagaaaaaaaaagcatgtacaaagaggctaggtagaaactgcaaaataagatgaaaaaattaaatccaaatgtcctaatcacaataaatataacaacacacagattttcacgttgtattttaaaaattaatgaataacgtaggctcaaaatatctaaaacaaaaattggagaattacaaagagattgtcaagttcacaattaaattgagagaatttgaggcctgtatcctactaattggtaggtaaaactaaaaagtaaaaaaaaataaaaacaaaaatatggaaaaatacaactaagaagcttgatctgatagtcatatactgctggcccttgaacaacacaggtgtgaactgtgtgcatttacttacatgtggatttttttcagctaaaggtggattaaaaatgcagtgtccacaggatgtgaaacttgagtaaaccaatggctgactttttgtatatgtgggctctgtagggctgaattctggactggagtaggcatggattctggtatacgtgggggtgtcctggaactaatttcccatgtatattgaggagcaactgcataacaattgaagaataaatgttttttctcaatcacataggagatagttgtgaaaattgattacacaccgggccacaaagcaagtatcaacaaatttcagaaaactggtatcatactaactgtgctctttgataatattaattaaaaatcaacattcaattctttcaaaatctgctagaatagataaattggagaagattgaatgaaaagagagattaacaaatggtagggacaaaacagctaaattactaaaagaaggtttttcaaacaaatggtagtatgcttaaaattttatgttaatattctaaaaatttggacaaaatggataccctcatataaaacagaataatgaataaatatacaaacattaaagtaattgaaccagtagttgaaaatctacaaattccaactatatacacacacaccgacacacacacaaacaagtacaaaaagggtgtccagttttaggagtgagttctacaggactttcatggcagagataattacattctttcacaaatacctactttcaaaaataaaaaatgggaacctccccacttaatagtttagtataaattcaaaaagctagaaactgactctggaaccaatactaaaagtaaaacaactcagaaaatatgtatagcaaggccaagagattcattatgctttgaatgcaactttgagagaaatagagcataaaattcaggaaaagctattatgacgaaaaagaaccagaattttacctccgtatacaaagattttatttcctaaacaacttagagagtgaaaaaagtcattgtcatgggaaataaagaacaactaataataaaatttagctaaaaataaaaccttataaccacatgttaaacttgtttgctgatgcatcgagacagaatggcaaagtagggagaggaaaagtatgtttttaaaataacatagtatgaatgaggtatcttaacgctatatgcaattatctcttctaatctttactaaagctttgaagtaattaatgtcataatttttcagattagcaaaaggaggctcacagttccaagctagccagtagtagaaccgaggttaactcagtcctacgctgtttcagaaacaccatatttcattcttgacaccaagatgacgcttaagaacatatcaaatttttaacttggatcaagctgagtaatatgagcccatttaactaaaagtaacactattttgtgcctaaagcagacccttaaattatacctcttaaaaagaaaacaaaatataaaatgtactatttattaaaaagtataaaaatgaatatgtattagttgaagaataatgataaaatgaacgcttgtgaaactatcacccaagaaataaattgttcttggtacctttgaagatgcctgcacatccctccttcccagcaccttcaacacctcctggaagtaaccagtatacagacttttgtgctagcctctataatttctttatagcttaaccatatgtaaagatatcctaacaagatactatttattcttaggatgatatgcaatgcttcattctgtattggatctcaatccagaaaaaaaagaagcttataaagaaaatttttttgtcacaacaagcaaaatttaaatctggaatatgtattagataatagtattgcatcagcaatgttcagttttctcattttgttaaatgcactgtgattaagtcatagaaagtccttgttttagaaagcactcttgagtatttatagaaaacaaaattaaaataaacacatggagtacaaagcacaaacctaattccctccataagatgaaggctcccaagaaaagatgaactgaacagagttgttccctggcaacccctttctgagagtttacaagactctattctggcaaagttgatgcaattatgaatgtgtccctgccagggtgaaggagggacagtttcatagtcagatagattgggaggggatacagggactcaaggttcttgcacatggctataaagctgtacagtttttgtactgcacaaacctggtagaatggcaacaagatgggggttggagggtgtgccgaagttcagcctagaaattttccccaagaagtaggcaatagaaggggtttattttgcagtgtatttattttgtaatgtatttattttgcaatgtatctgtttgaggaggtattttttaaagaattttcatgaatgctaacttcttgctgagctagttctactaacctcttattagctctcaaacagctttcagaaagttgttattttagccctttctgactgttcacttctagattcagagatcccttctgcttctatatcctgtaccttttgaagattgttgggcggcaggaatgacactggtcctctgctttctccactgtcagctcagggtttggcactcttgtgttggctaagtcaggggccactggaccgcctgattccagttataaaatttggttgctgtgtgtgctctcttgttctccccgtccttgagatgtgtctttaaacaaatccttcagtgaagttttagatgaagcaataggagaggcacatttcagccttccatcttaacatagaaacctctcagatatctagtacagaaacataatcactggtttttactcttcctttaaaatctgtgtgtcctgcaggaaataaggtgcaagaaggtgaagaatggattagtaaagccccagtgatgaagtctttagttggaaaaaaaattctcgatgtctgtctctgcctttccgggtaataaatgcttagttgtatgttcgacagccccgtggctctctagtgcagagctgattaggactggaagtagcccaggtgctccactctcatcaggaattagagtctagaatgatccgggttattctaaacctgttatattgggcagtgtaaccttagtgctatggtttgaatgttttcatctcccccaaattcttattgaaatcttaactcccaaggtgattatattaggaaatagggtctttgggtaggtgatttcctagtcagagccctgttattgccaatttgaaatcatatgcatttgatgcactaaaatgtgaaatccaaaaagacccctaaaatttgttaaagtgaaccttatcccaagaacctataaaataaaaactttgtattaatttctttaacaaataccttattaatattttataaactttatagggccagtccacagtcatgaaattcagtgttagtctaaaagcaattgagttcagtgtcagaggtgaatgatctcagtttaccactgagaattatttatactttaataaaaagtttctcagtctagattaacctagttgattagaaaattatgttaatgaaggaaaaattagagtttaaaaagtgtgtaagttaatttttcttgcattcacaatcttagctgtaacttctggaactggccaactggctggattcttttacagttactaaactgtaccagctgtggtgaggcaaaagtgtgagccagtgcaagaagttcatgccttgctgatgtaaatcaaaggttttattcattcctttctttattcactcattgctttattcagtaaacattctgaacaacttttctgtgttgagtagagttttataccatgatgttatataattctcacaagaatttcattatctccttcctcagggtctgaatgattgagaaaaccccaaatctgtgctgtatggcaaaaagtaaaataagaattcaaagccaggtcttctgactctaacttcaggattcttttccctatataatggtaatcagctaggagatcaccactgaaatagctggattattttataaaatactgtaattcagaaaacgtaaacaaaatttgttttatactgatatatatttttattagatttactgaaataaagatgtttagaaatgttttgttaatacacaaaggaaattgaaattctaaataattgccaacagaatagtattttactttagtctctgcattcgttcattctgtgtttctataaaacaatacctgagattgggtaattcataaagaaaggaggtttatttggctcacagttctgcaagctgtaaagggaacatagtgccagcatctgcttgtggtaaggcatcaagaagctaacaatcatggcagaaagtaaagggggagccggtgtatcacatggtaaacaagggagcaagagaggaagggggagggtccaagacttcctttaacaaccaaatcttgcatgaactcatcactatggggaaggcatcaagccatttatgaggggatctatccccatgatccaaacacctcccactaggccccacctccagcactggggatcacatttcaacatgaggtttgtaggggaaaatgttcaaactatatcatttcacccctggctccctaaatctcatgcctcctcacattgcaaattataatcatcctttcccagtggtcccaaaggtcttaactcatttttagcatcaacgcaatcaaaagtccaaagtccaaaatctcatttgagactcaaggcaagtttcttccatctatgagcctgtaagattaaaaacaagttatttaattccaagacacaatggtggtacaggcattaggtaaacattcccattccaaaaggaagaaatcagcccaaaaaaggaggcaatcgattctacaaaagttcaaaatggcagatcagacaataaatctccaaaataatctttgacttcatgtcccacatccagggcacattggtgcaagggtcgagctcccaagaccttgagcaactccacccttgtggctttgcagagtacagcccccatgactgctctcacaggttggggatgagtgtcacctgcagcttttccaggctcagagggcaagctgccagtggctctaccattctttggtctggagggcagtggcccccttcccacaaatccactaggcaactgcccaatgggaactctgtgtgggggctcaaatcccacatttcccctcagtactgccctacatgagtctctctgctggtgctgtgtccccaaagaaggcttcttcctggaaatcctggctttcccacacaccctctgaaatctaggtagaagctgccaagcctccttcagtcttgcattctgtgtgctcgcaggcttaacaccacatggaaaccactagagcttatggtggcttgagttctccaaaacagcagtctgagccatagctggggccctttgcaccatggctggacctggagtggcagaagggtagtgggagcagcctcccaggtggcagggggaaatggtgccaaggcttggtccctgaaactattccttcctgcctctaggcctatgatgggagactcagccttgaaggcttctgaaatgcctttgagccctttttcccattgccttggctattagcacttggctctcttttagttgtgctcatctctctagcaagtggttgctctgcagtctgtttggaatcttcccctgaaaatgcactttccttttctaccacatggccagcctacaaattttccacagtttaatcctctgctttccttttaaatataagttctaactttaagtcatttatttgctcctgtagctgataataggttgttggaaacagcctcaacgcctcttgaatgttttactgcttagaaatttctcctaccagataccctagatcatcattcttaagttcagccttccacaaagttgtagggtgtggacaaaatgtagccaagttctttgctagggcataacacgggtgacctttgctccagctcccaataacttcctcaattccatccgagatctcattggcctggacttcactgtccgcatttctatcagtgttttggtcacaacacttaacaattttctaagaaggtctaagctctcccttgtcttcctgtcttcttttgagacctccagctcttccaatgtctgctcattacccagttacaaagctgcttccacattttaggcatctttatagcaactctccactcctggtatcaattttctgtgttggtccattttgcattgctttaaaggaatgcctgagattgggtaatttataaataaaagaggtttattaggctcccagttctgcaggctgttcaagaagcatagtaccaccatctgcatccggtgaggcctcaggaagcttacaatcgtgctgaagggtgaagggggaactggcacacacatgacaagaaaaggagcaagagagtgagaggagaggtgccagattctttttaacaaccagaactcatgtgaattcattactacagggaggctacctggtcattcatgagggacttaaccccaggactgaaaattctctaactaggccccacctccaacaatgaaatcacatttcaacatgagatttggaggggacagacatctatactatatcagtctctaaacttccaccaaaatatattcttcaacttagtgggagagattgtaactgtatcatttttacatgttggaacattattttcctcattttttcccccaaaatagtttcattgtctattttattaagaattatactaatgataatcagtttttgttattaaaatgatttttagaagaacctatatttagctaaccaaatatcttatcaatttcccttcatgtgacattaagctactttcaaaatttattaaaatctattttaatgaaatgtattaagataatgtcataggaaattttacaagaatgaggcacgtatcaacttttaccaggcacggtaagcaaaattatgaattttgtctttatttcagttgtcatctttatctaatttaacaatgcaggtctaaatttcctcaagatttttttcctcatagaaatactaaaaagatagatgatcaatagatgggttatgttttaactagacaacttgattctaaagtccctgaatattatttttcctgaaataatgctgaaaatgaaaatgagagggttctacacctatcagatattaaaacttatatatctataataattaaaacagcatagtcctggaatacaactataaatcaattagggaacacaaaatctataaacccaaaatacataaaataatttagtatgtattcaacgtggcatttaaaattctagagtaactgataaatggtcctgagacaactaggtagccagttcacataaaaggaaatttatatggtttgtaaacatatgaaaagctgatcaacgtcatttacagtaagagaatttcacctataaacttcatgaagatgaaaacattgacaagagtgttgggaatcaacacactcattcactgctcgtgggaatgtaaactagttcaatttctataggcaattaatccaaattgattaaaatttaggatgaacactccctttgacacaacaattatacttctgggattctattaaaatttatctttggaaggtacacaggaacctgctaatagtgtagttgctgtttcctgtgaggaaaaatgggtgtctgggggcaagatagtgagtgtgttagtctgttttcatgcttctgataaacacatacctgagactgggtaatttatacaggaaaaggcatttaaaggacttatagttccgtgtggctggggaggcctcacgatcatggcagaaggcaaggaggagcaagttacatcttacatggatggcagcaggcaaaaataaagagagcttgtgtagggaaactcctgtttttaaaaccattagatcttggcatggtggctcacacctataatcccagcactttcggaggccaaggtgggcagatcacctgaggttgggagttcgagaccagtctgactaacatggagaaaccccatctctattaaaaatacaaaaattagctgggtgtggtggtgggcacctgtaatcccagctacttggaaggctgaagcaggagaattgcttgaaccgaggaggcagaggttgtggtgagcccaggtcacgccattgcactccagcctgggtgacaaaagcaaaattctgtctcaaaaacaaaaaacaaaccaccattagatctcctgggaattattcactatcatgagaacagcacaggaaagacccacccccatgattcagttatcttccacttcgtccctccacaacacatgggaattatgggagctacaagatgagatttgggtggggacacagagccaaactatacgagtgagtgagtttgattaatttttttattctttgtactttcatgtcttcttaattttatccatatacacatgcatgcaatccaatttaaaaataaaaatatggaaagcaaaacatttgttttttctatttaagttttagtgaaacacaaatttaccatgcacagtttcagttttac

SEQ ID NO: 3145 - DNA, 1029 bp, Homo sapiens
agccatcccagtaactgaccattcacttacagttgatttaaaaaacccctctgcatcctggctagttgctcctggtttctttttgccagaagtcaaaagaggaagcagaaacacagttatagaagtgcaattgttagtgttacctagatatttctttccttcttttcaggcattaaagtagcaaaatgggcatctattggccctgacttcagaagatgaacaaagaagggcagaaagagaaccacaatcctacacacaggagattttgaagtttcacaagacagaatctacatataagaatgggtatgtattcacagttaaaacttcttagtcttaaacaaaaacaaacagcaaaattcattgagtataattttgtcaggggtgagtattagagtaggcttagtttgagtttatgttaacttcttttccaatatctcatctacctcctctagaaacaaggatagaaaataatgagcctcaagtctgtaataaaatgttgacaattcatcttccatagtcattcatataggtttagtcattctcttttagagaataagagcagtagtaatattgagatgcagctggaaattccatctattctccttttaagtctaaaagtgggaataaaacaaggaagcattagttgattatgactgtaaataaaatattttctgattaaaaatatctatcttctttttttggagatttccatcaaaggcagagtaaattgtcccaagacagcaattcctggattcattaatatatatataaccttattctgctttggagtggaaatgaagatttctgatcttagcgtctcataaaatgttggggttttacacctgcactactatgtatgagggcaggggacttagagtatgcctctggacctgatttcagccctatgagagggatttaaaaaaatacaataaaatgaaacagctcacaacacttaattaattttaaaacattacagtatctatagttaatatttgttattggttgaatggtatccccgcaaaatacaca

SEQ ID NO: 3146 - DNA, 4158 bp, Homo sapiens
gagatgctgaaagtgcaaatttgtatatggaatcatctacttcttaaaatggtgtgtgggctaacggaaatgtactggcaggcttcattcacatggggaccagtttacaactgaagacttggccttgaaaaccagtgcctttttagcctcctaattggtctccctgcagccatccttgttctctcctctgttctccacccagcagctagagtggtcttttaaaaatgcaggcctagtggcatctcttctctgtctaaaaccctccagaagtgtgctgttagaattagggtaaaggccagaggctttcttatcctttaggaaagtcttcagggctccctgcacccaccaccactctctcagttctgtctactctttttgcaactccttttggctcctctaaatcaccacaccagcaactaaagcctttgccggtgcttactagtccacccacttgggatgcttctcaaccctcctacccacattatttagcaaagttttaaatgccttccaaggctcagcttatgttttaacagaccttcattaaccccctacactagtctgcttccatcccctttgtatttggtcgatgtgccctaattctttcatgttgtactgcgatcagaccttgaattccaatcatctgcttaacaattgtctttcctactggactatgatgttccttaatggttggaatgatgttgggtttgtttgatggtgtagcttttgtacctggtacagtgtcatgcatgtagtatagagctttataaatatgcattgatttgacattgaattaacactttctgtgataagcgtggaatgttggaaggacacaggatttcataaggggataagctgtggcttccccgcagtgatctttagactgtgttttctctaagactcttaaaatccattcttgtgaaagaggaggcagttctacgcggtgacttgctttctcttataatgaacttgttttgctttctgaaagatagcttattaattgatcactatttttcctcaaagctgctcagtggtctttatatttattctgtgacataaaaaagaactggaaggactttcagaatgtcaaatacatagtcatgtggcctgaaagttaaaaacatctgtacttcaagggctcttaagatgactggaagaggaaaatatgacttcagtagataaacataaaaaaggtaaaaaattaaaacatttcattactctgaatttagattaagaatagagaggagcttatatcattcagtaacacattaatataaatctagatacatcagggggagccaatggagatagatggtaaaaagaagtggggtcagagagagaagctgagaaacagacacaagaaattcctgctttctcctctttcctatctccattctttacatgaagacctagaaaggaagagacaaactttcctgtatctatggcagtcacctgcaaggatgtcactactaaaagcaatagtcaggcctttctttttggatgtgtggcacaactgtgggtagatattatctcttagttcttatttaataacctgtgtaaaatgtaatggagcccacctctgcccaaaacaattgcagattgtgtacattgaggtaagattccttattttctttagaaatgtgtagtgctcttatttactgcacttttattccttatattaaatttatatttatagtgcagaatttacaaaccagatgaaagtatctccaaatgccataatgcattggctcatttctattaattacttcctggaagaaaaatcattcttcttagagtaaaaggacatcaacttctctgagcaccaagatactgcctaggttcccttccaggatattgactcaggagacttcattgtgaagaaatgtttactaacaaaactggaagccaatgtagaatacactaatttttgcaggaaggagtttccagtctctttttcaaggatttttttaagatacagctggaccaaaggttctggtagcactctttgaatacacctttctattctatgaactgaatgttgcaaacctgtcacagagtcatagataagtagccttgcaaaggaactttcaaaatcaagtgagtaaaaaatgttgtttttttttttttcctgggaaaaataggactttggttctcttgatggactgtgtatggaaatccaggctgtgatgaggtttttaacgtgggccttggttttaaataatgctttaaaaactgcatttgcattttcttttattatctccatgaagggaagtagttagaaatcggatcttcaagaaaataagtaaacatcactggcattctttaacaatgtgaactctcctgaaatcctgctctttaagggatcaaattttttatttccttatgtttcatgggaactttacattgaatagacttgagagcagcctagtggactaccttggccttattttggctgatagtctcattagaaatataccaaagggtaagaagaatttaattatgcctccattagtatcccctccttgggtgattttgtagccattcatttagaaatagtgtttgtcagatctgggggaagactctagggtgatggtccttgatgtcagctacacgtggaaatcaatagagagttgcatatctgggtttccaggccacacccaaaaccagtgaaatgaattcatggttacatcgtatgcatcagtattttcaaagctccaaagggtgagtccaatatacagccaaatttgagaatgactgctttcaagattaaccaccccagttgttttaaacaattggtaagcattggaacactttttgcacacgacatgttacctggaatctttataaaagatgtactgttgcctaaagcagggcagggtctgaagtcaacccactttgcctgccccttgttccctgcccctaagggagattctgtgaaactcagggctccttgaagcactgattaaccactgctctaatttggaatcctcacttcatgggtccgagactcaaagctgtccagtaacttgctcaaagatgctttctttttttcctcccttgttctctgtcttccacctccactttctttcctcccaaggaggaatgcagttaagcagaagaaacataattttagcctgatgtgttagatttgaacagtggcctttcctcttccactctctcttagatcttcaagccctagaaagcagtgaggaagaaagcttagaactccctaagcactaagtgttgtctgtggactgaatacataatatctgagaaatatatttgctattattttttcatatacagatgccactgtgactgataaaaaacaaattcatttcaaaaataaatacattcaaaattataatatacccttaccagctttttgtcatgatgcattttatcaatcagtaatagcaatggtaatagcccttactgaacatttactatgtgctaggtactgcacttagtgctttatttgtgacttttctttgagtatcataagaaccatgggagacaaaaattattatctccatgtgagaaacagtggctgacaggtaaagtagttggactgtttgtctataactaaggctggctggctcttaaactgtgcttgactactcaaccttgtgcctctcaatagataactgatagaagtatttttttcacccagtcatttttttctactttaaaggaactttcatttcaagagggctgaaaatcactgccctgcaacatgctgctccttttcctgttccctgactttttactggactctgcacatagctcagttcttcttttcataaagtgatgacaaactcaatgtctgcagggatgaggcagggaatgttaatgagtaaaataggtcaggtttgcattttaagcatgcaggaaaggtttgcaacatcatagaacaatgagaacatgcgacaataataatcacaggataatctatttttctgaaacctgctgctctctgggaccaggcttttcttctctttattcccacttttgttagaaatgtagccaccaaagtatttctctatgaaaaattatctatctatctatctatccgtccatctgtctatctgaaacaagtttaaatggtcatagatattagactttttgccagagatacaataaggagtggtggggtctagg

SEQ ID NO: 3147 - DNA, 4540 bp, Homo sapiens
tgaaggttagcagcccgggtagggttcaccgaaagttcactcgcatatattaggcaattcaatctttcattctgtgtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatgaaccaagaaaacccacacagtgaggattaaatcggtttcaaagttattttgaggctgttcatatggtgcatacctgtaagaaacaaaacagaaaaatttctttgcagcaaaattctgacaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatgtaagtggagtctcaaaaaactttttccctgttttccttatctctgtgatttgctcaccttccacagtcatgtggaattcacacacgacactaacgaaatcttgccaagggtaggtgtgaatagagatgacatgaaaatggggattgatatggagattttgagatgaaacttgagtgacagttggtggaaaggcaggagttaggcgtcgtggatgtcagatttgtattccaaagcagtggctaactcactgtggatcccagagccattagcagtaactcaagcatattacacagtcacacggtgactccatttcccctatcttgacaatgggtataaggatcttcgcctgtatcggtgaggataagataaaatgataggcatgaatgttaacagtagtcataatttgcccttttttaggagggaaggattgtataacttgtggaagaaacatttcaaaatctgggacactggcatttttccaaacttgatttcgtttttcttctccaagccatcttttccaaacaataatgcactttattagtgcaaaagatattttaaaaatacattaaaaattggctactggtccataaatatctgatgatggggatttgaaatataccggctttagtataaaaagagtatgtgtacactgcaacaaatttcgctctttctctatttgatgtgtacaaatgtagggaataagaaagtattaggtggatggcttggctcaagcaggcatagggaggtcatggggctatgtgcccagtgatgctcttgtggggctgctgctctttctgtcactccatcatggggggattttggtgatggcgtgctgtgcacatgtgagcagtgggctgggtgctgcgtggggaccctagagatacctgagacatggctgctgccctccaggagcataggataaagagccaggcaccccaatcatgatcctctaatggagttggaggaattacattatgaatcaagggctcttagatgttggaactgggaaacgtgacccttgggtgaaaactgattgaagaggtaaagcccctgtagccaaccagaggcattactctgagggtgctcagctgggaatcttgccctctgctgggagctattgctcagggattgtagcagatgtttgttggtagcccacccagatatctttcctaactgtactcctgccccttcacctttcctaactgtactcagattttagttttcttttataccccttaggtttcaatgtttcagagaaagcttcacagctgggatccactcagtcaattaaagccaatcagtgtattttatgttccagccgcatgcgtgaacatgtaacctaggctggttcaatgagagggaattcaagactcgtgcgtagaatatcaggacaggagtacccttccctccatccatgtgaacaaggaaacaggtagccacaagtacccctggtggccatcctccaatccccagggaagtcagctgtaggacaaagcatgcactgtagatggaaaagtggaaagacagaaatcaagcccttaatagcaccattgaattactgaaccagccaaccctatgaaaccactgcctccaggtcgttttgttatatctgccaagaagaacccattacagcttttggaatgagtgtcttgttaatatttagagtcctcatgaatgagaatggactgggtcatcagacaggaaagcatcctgcatgtgccattccttctgggaagctctttttcctctggacaattccatctgcagatcatgggtcacttttcatccagttcctttccctctctccaaattttagagccattgagttactcaaaatccatacatttgaagataggaagctaacattcaattggctcaggctctaaatccttccactgaagagaaaagcaggataacctgaaatagccagattattcctatgtgtgagattcacgggatgatcaccttctgctctagttttggtctgatgttctgtagacatggatggcacacagcatttctgtgggagaatttcagttcaggctgaaattataaatgagtaagccagatgtggactcagggaaaatcagtacttttgcattattttgtgtgggctggagacccatttcctgcttacattacttaaaacccatatcctgctgctctgtaaaaactggcagcttggttggcaattaaaaaaaataatgtttacacccacaggaaaactccagcatcagccctcaaggagcttatcaccttaattagatttaaaaatatagaaatgggaagaaaatgggatcattatgtccaagtacacaaaaataaatgtatttttgttagaaggaaattgaagggaaagaaataaacacttggaatgtagagattgagagtctaattggatatttttaaagttgaaacagaaggaagcaggcaaatatgagaatcagtaaccaattataccacagtatacgcaactgaaatgaaaccaagaataatagatactcatagaatgttagaagtgaaaagggatcttagagattgattttcactcacctctctcatttgacgtacaagtacactaggactcagaaagatgacacggttctcccagcagtcccaactggctgaagacataaccaagactacagtgaaatcggccacctctcctccccatgccttctctgaagtagcgagattagcaagattcacattccattctagccataggacatgtcagttcatctgtatgtgtcagaatcctttagatgagagtgacagaaaacccagctcaaactggcttaagctacacaactctacgcatgtcactgaacagtccagagtaatatgctggatccaaaggcacatgtttgtttttggggcattgtttctctttgtctctcacagctgatttttgctgtgctggcttcattcccaggaagattttccccatgtctaacaaagaagggcaccaacagctccagactgttaatctattgacccagcaaaaagagagactattagatcccgattgttccatcaaagcctagggacagattctcattggcctaacttgggtcatgtgcccttctgtgaacgcattgctttgagcagggcattgctttgggcaggggatagaatattgtgattagccaggtctggatcatgtgtcaatatctacagcccaggattgaggttgacttcacccaaaccatgtgggtggggagtgtggaagaaaatgttcctcagaggggaatcagaaagacaggaggcaaaaatgacctcatgtccaccatgatttgtcaggtcccacagtgctgttcccaaggcactcttctttatgctgtgggagaaaaaaagaaggataaaactgagaaaatttaagaatcattatagtaatagctaactggacagggtattttctatgtgcc

SEQ ID NO: 3148 - DNA, 2909 bp, Homo sapiens
cttgaaatatcctttttttcttcagtcttgcatttccatgttgtgcaaaacaccatgctgaatgagataacttgatggtaatgttttttttactgaacgaaagtggccctatggtgatttaaagcagggaaattagtacaaatgagattttccccactttgcttagtatcgcttcagggccttaaaatccaaccttatgctttcaggttaaatcatagaataactctatcgagatacaagcagttcgtgaaagagacagcaccaatcattgatctcttacctttaatttgcttttcttattagacacagtaattttagcagaatgctaataggacaaaactgaaaattacagatgacgggagaccacttactatgaaaagcagctactataaaagctagtcctcagtttggtccagtgtccaagtcccacctccagagccaagtccctcctacctcatcatgaaaactctcagcagccctgtggaaagaatggaggcctcctgtccacaacaagcaccaacttcccatgcgtgtgaaggagccacctagaaagtcatcatctggctccagtcaagccttcaggtgacatctgaatgacatcttgaatacaaactcatgagagaccctgagccaggaaaacacagctaacctgttcctgaatttctgatttacggaaatgttgtgagatgatgtttattgttttaaactgctacattttggagttatttgttctgcaacaacagaaaatgaatgcagctcaaattaaacttagctacttggtggccactttcattttaatatcagtgtagttatctatccagaaggcacacccagggacagcgactgtatacttccaaagcagcccgaagtatgtagctttagcaatattccttcatcattcttatggtggcttactctttgacaatcaggtgactgaaatcgttctcatgaacaattacttaagaatgctttcctttcttgaatctagggtgaatggttgaggccagagaactgtagtcttcaagctctatccttttagagggctgtcgaatctcctcagagtagagactttgtgtctttaatttcagatatcctcccttgagaaagtagatgctacttcatctgtcatatgtcatcagggcatttgagactattagatctatcctgtcagctcactacaaaggaaatgtaatctattataaccctctagtttcttattgggttttaatgacttaaaaatattatattttatttacttataagattacaggaagaaagaaataaaggtaaatggaagcacacagtgatttctttcaaaaatactgagaaaaaaaatgaaatgctccactgggtgcttcaggaattaactttacaacctaagggactcataagataagaaaatacatttttgaaggttatatttaaaagctaattactatagaaacaaaattgcattttgttgggaacttccatagatttacagtgttcctgctcaaaaaacacaaaacaaaacaaaacaaaacaaaaaatgaaaaacagcaaaaaaaaattggaaacattaaacttcaagaaaccttaaaggtcagtttctctaaccacatgtcggaagctttaattctcaatatgctttacttctcagaacaacataagatgtgttaaaaaagaaatgtacctatactcggtaggtttcattacataggataactatttatcattataagctaaatgtgaaattttccttgacaattttttaatgttttgaaccaatgaaaaaacgtttttcataaattaaaaataaagttgtaagaatatgaaaaataccagttttttaacagctatgaattttctttaagtaaaaaaataagcaatatgtgtaacatttttattataaaggagactgtaatgttatagtttacagattatgttttaataaatatgttaaatatgcatgctaaatatgcatgacttaattttcatcaaggaatctttgttaaactatgctgtgaattgatttcatagctaaagtctgaaaaccaactagtatccacttcaagaaaggacaaataacaaatgcttgaacaaggatcttacaaatacagtaatatttgagactaacaacttattttacatagttgctaaatgatgattaaaaccaacactatttggaccggacgtggtggctcaagcttgtaatcctagcactttgggaggccaaggcaggcggatcacaaggtcaggagatcgagaccatcctggccaacacggtaaaaccctgtctcttctaaaaatacaaaaaaattagccgggcatggtggcaggtgcctgtagtcctagctacttgggaggctgaggcaggagaatgctgtgaacccgggaggcggagcttgcagtaagccgagatcacgccaccgcactccagcctgggtgacagagcgagactccgtcaaaaaaaacaaacaaacaaacaaacaaaaaaaacactatttgaaagtgaaaactgcctaatttccacaactgttacaaagcataaacaaagattattcaaccctgtttattgctatattaacaaattataccatctttcattataagtataaagagatgccttaaccatatatttttaaaatttgccttcctcacctttggtattattctgttattaagacgttttcagtctgaaatacatggtataacaaatggaggatagttatatagatagatcttccagggacaaaaaaatggcccattcttatcttgacaatgtttaccaatagtgatttattcaataggtttcaatccagtgcatttcagaaaatgtaagtcatcagctggtttctgctgtcaaatcctgttattattgcagacaagtacacaaagaatcgtgaaaccaaagtttccgggtgagtgtg

SEQ ID NO: 3149 - DNA, 20216 bp, Homo sapiens
aaggaagttcaggggcgtctcagccccatccaaaccagaagagatttgtcactgatgctaatgcatgctgctctgcaggggaccactctccctcgaagctccccatagctgctctcagttttatggatctgctctactcaaagccttgcagaaggggcaggggatgcccaggttaacccccgcacgtacaaaggtggagcagttttcatgcatagctgggacgaagaacactggaaagagaaagaaaaattttccgagctactgctaagccagaaaagctcagctctcaaacggactatctcctgagacgtcacacagctgggaactgatccgcaatacagcaaaggtacaactaagaagatgttagcccacatatagtccagccgtgcaatgtattcaagtgatcagtccaggatcatgaatcctgagtgatgacatcagcccaccattttgaaatctcttccagccccaagctaagttaagttattaaagctctttatgactcattttccctaatctctggctaatgtaaaagacaaactgtttccacctttcttgtgcaactgtattcactcattaaaactctcctccagaagaataatattttacttctaagagaaataatattgtgaaagaaaatgctattggcttccagttacataggtcagatttccaagtcctgtggcagacaatgatgtgcaatctttctggtaacacatgggtcagcctccctctcttattctcatctttccagcagtgagtgttttcccaataaacacaagcaactgcactgtgttagggctatcttgtttttctcagaagtatttttcatttacacttttaaaccttttcaatctcatgaacttcctcctttgttatatttactgtatcctgttgtaataagaggatttggcgttttttataccaatttggaaaaacttccttcctggcatccagattttctcttcagatgtcaaaattggagataatggtccattgctagccctggggtgagagagtgagggagggaacaaggggagctgtggtctcgccacgccaatcaggttgacacacttcatgtgtgctgagtggcccagtgtgtggcaacagaggtttactgttcactcctgcgacaccgggacattaaaatgcaaggctagtggtttgaaaattgtcagtatttctaatccacgcactttgaaaagtcaataggttttctaaagaacttaatcactcagaacaaagttggatttattgcaaatgccaaatttcttaatcaaaatccacttttcctggcatatgacatacgtacatctttccaaagcagattccattcaacagtttccttcttaggaaacactaaatatatgataaatcatgtttttaaaaatatctagggaaataagagaagcatataacttagtgtaacttgcctataaaaaatgtcaagaaaattgcttattaaccttcaaagtcctttttaaataaaaccttaatttccaaaggggcctctgcaccaatgtatatgagaattgtttgtgcttaaaaaaacctattggcaggtggtggggtgggtagtgggggagacctacaggattgcctattacaacttcttcacttattaatgaggcaacaaatccggtgggggtgaaatgaaaggtccaaagcaatttaccactggctggcaccagacttagaatccaactctcaaatcggtgcccatttcatgtccctgcctctatcatttgaggtggggtctgagaagccaaaacataatgagaaaccataatataaacgtttcaaaagtagaaactagattttgacccatagccacttcccagtctcttcataccttaaatttctgtctgattgtctgattctgtctaactctagcaaaccagacaactgactggagttatatgagtgcgacagagtggactgtaaatccttaggtacaattcactgcagaggcagtgtccacactgggtatttggcacatctcattcatccatccattgtttcattaaatgaacattgaccgagcacccattatatgcaaggcagcaagtaggttttgaatcctgcaaattacagagaaaaataaaacagtctccctgtcctggagatgctcactttctagtactgaagatgcacaggcaactagaaccccacagtgagcgtgatgccgaaaagggacatccaacttctctggggtcccagagggcatcccaggcagagggcactgcacagggaatataatttgacttagagaactgcaattccttcactgcagctaggggaggtcttctgaaacttgaatatgcatacaagtcacctggggatcttggtgaaatgtggatgccataggtcaggagtgacctctgaaattctgctgcactaacaagctcccaggtgatgtcaccgtgccctgtgcaccacactctgagtaatgctccctgggaggtgaaggtgggaacctcagcaaaagccagttaataaaatgtttgaaagccatgctatcatattgggattctctttgaaactaacaggagtaacaactataattgaatttctttaaaccgatattggctttctaagtttattggaagctcaaaagtcatttttgcagggaagctttctcatccttccctgagtggcgaacacatgcataccttgatttagagcgtgctgcactgtgagctaacactgattcacccactcatcaaatgcactggactctaagcactgggaggaaagaaatgtcttttttttccttcatacatttaatataatttttcttttcttattatttttatttttatatattcatggggtacaagtgcaattctgctacactgatgtattgcattatggtgaaatccgggacttcagtgcatccatcagtggagcaatgcacgttgtacccatcaagcaactgcttctggtccacagtcttcagtcatgtcttttagttttgaatcctcaacccgaatgcacccaacacctaacactgtgtctgacccatagttttttccataaactttggtcacattatatgtttgctctagattagtggttctcaaatgttagcctgcattagaatcccctgcagggcttgctaaaacacagattggtggatcccactcccagcatttgtaattcactacatctgggtcagggcttgagagtttgcatttataatatgttcacaggttataatgcaaaattatataatgcaaaattgtaacctgtgaacatatcagaaatgcaaactctgcaggtgtggtgaccacattttgagagtagatagatagataggtagatagataaatagacagatgacagatagataaaacacccagtaactgcaaattaatattaattatttgtagtaaaggaactcacctcacttgctgctggcacagacaggataaaacagttgtttaacaaaagccacaatgtgtttcgttacaaacagaccaggcaaatgtgagtttaacccttaatcttttaaatctataagaatattaaaactgctgttgcatttttgtaatcacagtttttatttgttcttaattagtaagaacaccagctgacttgccacacccactgggatggttataattaaaaagagacataataacaagcactggcaaggatgtggagaaaacagaaacttcatgcattgctgctgggtgtgtaaaacggtgcaaccactttggaaaaacagtttgacagttcatcgaaaaattaaacatagaattaccatgtaacccagcacattcactcctaagtttatgtccagtagaattgaaaacattggttcttgtgaaaactttcacatgaatatcagaagcattgttcatagtagccaaaaattggagagaacccaaaggctcatcaagtgatgaacagctaaacaacatgtgctgtatacccttacaatggactgtcactcaaccataaaaaggaaggcagtacttttttctctaacatggataagcatgacccaacacgcatgaaacttgaaaatatgatgctaagaaagaagtctgacacaaaggccacatattgcatgattccatttatatgaaatgtccaaaataggcaaattcacaaaacagaaatcaggttagtgattgccagggctgggaaaagaagggaatgagggaatggggtatgactgataaaggtatgggatttctttgggggataatgaaagtgttctgaaatgaaatagtgtttgtatatattttagtatagtcttgtgaataaactaaaaaccactaaagtgtacgttttaaagcatgaattttacagtacataaattatatctcaatgtaaaaaaaattaaggccatctaatgttatttggtggtgctaacattttcattttagagttacactatctgataaggtagccactagccacatgtggctcttgagctcttgaaatgtgactaaagtgaggtcgagtgcagtggctcacacctgtaatcccagcactttgggagctgaggcaggaggatcacttgagcccaggagttagagaccaccctgcgtaacatagcaagaccctgtatctacaaaaataaaaaatatgtatacatataaaaaaaacaaaaggagctgtgctgtgcaggtaaaacacaccctggaaatcagaccaaattttttttaaaagggacataaatatgtgaatacatgtttaatattgaaatgacagtattttagatatatttagttagctaaaatacagtattaaaatgaactgatttgttgatttttgcttttcaaatgtggctactggaaaatttaaacctctgtatgtggcttgcattgtcatcctattggccagcactgccttcaaggccctccccaacagggtgagtgtctttgtaaagaacatgaaaagtgtgcacatccgagggttagtgagatgggtgttttcctttacatacagggctctgtacccagggcttgattagctctgttctattagcaagactcagcacaagtaaacaggccaattcaatggatatttccagtttttgttctttgagtagaaagccacctgcaaaaacagagctttgttatctcaaagagcaaggttctgggccattattattttagaaagtactttttgtgtctctgcctaatggactacacagcaagtcatctgaaaaaggaatttttaaggcataatttttgtcctctttagaatactcttttcccaaggctcaagtcctgcatcataacattcttaaccttgacatgtatttctagatatcagtgaaagctgatcataaaactctgctgaaaggaaaaattcctttaaaataaaccaaagataaggatttatttggtaggcaaagtagttaagggcaatttgtttaaatggtgtaagactgtctatcagtaagaagctaagttgttcacttttaaaaatcacagtatcttttgattataaaaactatagatgttattttgaaaaatttcaaaaacaccaataagaaaaataaataatcaaacacctaaccacactactagagaaaataattgttaatatatagatatctatctttccagggaaaaaagaggtcttgataagtcaaaaattttctatatggagaaaactggctcaatttctgtcattgactattggttaacaaataatagagcatttacttatcatccaatcagaaataattctattggttctctaaatcttgagaagacaaacccagttgttacaggtttagtcaataacatctctgtattacaatttagtggctggactgaatgtaatccttttgccttaacttcaacaaaacaagagagacatttacagtgcacacatagatgatgtgggtgggcatgtttctacacatttttctttcctcttcaccaacaaggttgtataaaaatatttactgctttcctatagattcatgtatgtggtgtagtatccatgtcatgaagcagaaggatggattattcactggagtttttatggctgcacattcaagtgtttccccagctgtgtttacagctttgggtttctaagcctcttgagaagtaatcagttttgatcatcttaaatcccaaagtaaattttcttttctggatattatcctagttgctaacacaggttagtctggcctattgaaccatcttttactgctgtgaccttcaaaaatgaaagctgtggttttgccctgagaagaagaaaaggagatttgaaatatgactcagattcttccctgcaaaaggctgggacccttgaaaactatctacgtggaaaagtgagagaacaaggggacacaagcaaagctgcccaggcacctgttcaccgaagttgaggctggtcacaactccggcggcccaaggagctgctcggttcacccacaaggaatgagagctgcctgcctgctgctgcttggagagccccagacagtcgcttgaagaggtgagttgaaaccctccatttttctctcttggcatttagaccactggcccctgagggatctgaacacggaatttgaatgaaaaaatacaagctgaacggcttgtcgctagtgtttgccccagagggagaagcttttttgagacagaagagtagagagatgactttgacattctagttgcacaataaacttctcccaggccagatatttaatcctttttgtttctctgatcattaatccagcctgtgcttgtcctcgtacttgatctgattaaaacaacaacaacaacctaaagagaagtagagtgaaggcttttgttttgaaacttagcgcgaaggtgcagatctgttcagcccgtttaacgggggctaggaggccagtgcagactggattcagagttcttatttttccttttcttcctccctgtattttgatctaaacctgtgaagtgtccctagtttttttttctttccccctgaaaacctgttcctcagggcaaattctgttgccctattcagaagctgtgcgttccagttttcctctcttctctgaaaaagtctaccattttctttgctctttgttgaacactcttttaaatacgactttgcagtgtgcatttagaatttgtttacatttagacctggactggctgcctgctgacctttggttacagtaagaattaattccctcattgctgcaagaatgtgacttcaggtctgatttttaattttttggacctctttggctttttctgtctctttttcttttaatagcaaatataccgaggaagttgttctgccaggacctggcttttaaagtaattttacctctaggatccatttttgttttcttaatcctgatcacacagcctgtatcttgacagcccaatagtcaaactctttagccaatattgttgtcagagaaaggaaaccatttttaagcccagctgcctgctgggatgagctggaaaaactggaaaaagaaataaatctgcgagacacttcattctagattccaacatcagctgtttttctgagatttaagttagcagatgtttgcaagggaataatctgttaggaattatgctcctgttcatccacccagaaatacaaaatgcatgtaaattctcccaaggtatgaattgaaacaagctgagatcatttttgccttagacagacagtcgttcctcaccactaagaatctgcccagttcttgttgctaatttctgtcttactgtttggaggtccctattgttcttccttaactgacctttgtttattattttccccaagcttgtgagtttaagggggggggtttggccaccacttgtctcttactaaggttctcacttgattcaaagcttggatcttctgataaaagtgcatctaaacctctcctcaagattacattgcctctggtttaccatggttgattagtgcttttcacagtagttaatttatgattaaataaataatttcatcactgtatgtcagcatgtctgagtactaaaggaacaaagctgtagacactgtacccccaggtagaagaaagaaaagaagtgacaaagactggaattcagagtcagattgactagaatgcagttggtctgttgggtaatttacacacaagtcctgtccagagttcctgtggtaactccacccattggttcaagtggacataggcctgatggaaaaatgtgcaatctccttcatttatatccttgagcaagttacttctctgactttcagtttcttcatcggtaagatgggagataataatccccatgatctaatgtggttgtgagaagtaaatgaggtagctaatatatgttagcatccagcgaccaatgcctggtgttaactggtgctaaactgaggctaggttcttcctttggaaggaattttcctaggttgcttggaggagagagtctgactctatcaagataaagatcatatgtggttgcagttgtaggaaccttgatagttcttgttattgtaattaattgtaggtaattaactgcaatgttaacagtttggaaaaagaaaacaggcaggagaattcttaaacaatgtcatcaaacaaggtgggcagatttgtctccgctagcctcacaggcaaagcttttaggagttgctggctggctgtgatttcttccttttcccactctaaggctctcatcctgcaacagacccacaaaatgtgattctccatgggcctttcgggggaaatgtccagttgtcattgctgtaatctgacttggcagagagttctttttgctgtcagtcgtgctatctccagggcagactgggtgtttggtctcctccagtctcacagataaacacccttctccctaaccagagtgagggttcatgccgagcctctggcaggaggaagcccctggtttggagcctcattgtaccatagaaggaggttcatgacccattggatgtgattggccttgtcatgcaataccctgtgcccttgggtgaccttgagtcattgcatatgagcagttgtgtgcccagggccctggtcacttctctgggtctcgcccttcagggataccacaaattttcatcattcaagagtaagggattagtggattgaggtcagtgggttctactgttctactagcttgcctacggagccctaagggagaacctcaacccccctgcatgtcagtttccttagctacatttttccccaaaggacgctaaaatggtgtacttcacaggccccctccatccttacaactgaagcaaggtgggctgcatgtccaggtgggtaggtcagactgactggggggactgggtagtgcctcactagaaaatatcaatcttattcattccattctaggtggggcaatgctactgctttagaatagtggtctggtctctggcatcaggctgcctacctgggtttttgaaacccagatctaccatgtgctacctgtgtgacctgggacagattctttaagctgctctcatcagctgtgtaatagggttatcatgaagatgaaatgggttgaaatgtgtaaagtgcttggaatggtacctgccacagtgttacttgtaaatattgaaaggaaggcatagttgatagtatcagacaggtctgtgtatcagacccagttctaccatgtagttgctagcctaaataagttccttaatatttctttgctttggtttcatcagctgggaaatgaaatacttcccagactcagagctgttgggaggaataattgaaataattacatggaaagtgcctggcatattttaaatgttcagtgagtgttaactattgttatattattttaaacatttttatattgcttacagttagacatcttaggtcatgctactatctggatgtaataatgatggaaacggtagtacgttgagggccaaagactgagcaaaaaaagatttcccaaaaggctcccaaaggcagaggaggaaaacctgttaacaaagattgtgttgtttctcttggagttccagggtagagtggctgccagtggaaatgcctggtctttcataaacctgtggggagtgggcttctgtgatgtgagtaaacagcgggtcttcctggagcggtgatttcctggcttcacctgtcactgtctccttgtctccaagaccttggctaagacttcctttctatatttgaattcctcacttaaagtggagaaaatagggtctggtgggatcttgactactttttttttcctttcactctcttgaccaggatacgatcttgactactcgaaatgccgtctgtaagatgctggcaaggcgaggacacataagagatgctctaaagtgtgtcctcctcattgcctcagtattcatggacttcccagtagcatacaactattcctaatatttatgtactgacattacatagactctcttttatgtggttggcaaatttattgtcctctgacaatgcctccaaagtatcaaaggcttttcaaaactgtttggaaggaagactgtgtcactgttcctgggttaatatgatttaatcattaactatccccaaagaatagggttgacatgaaaaccataaaaaaaccataaaatgtggaaaactacactgagctgaaatcaggaacagaaaacgtttgttgtctcccgtaaactttctgtgtttaccctttcctccattttgttctgtgtgacatgaggacaccacagtgacctatttggttagttacacagatacacacttcagatcagtaagaggaagaactttctatgaattagagttgtccgaaaatgtagtaggttgccttttgggatactgagtttcttgtcactgaaggtgatcattttttttggcatatttagtgcatggtgtatgtttgctggatgagtgaatgaattaataaatgaatgacaaagaggatttgtgtttttcagctgcacatacactcatctgtaaagtgaagattaccttaatgatctcataggattattttagattaaatgaaaaaacatgttgaatacccagcacagtatcttgcatattgcaaactgctcattaaatagtaataatcattattttttattttatattctaaaaagaatttctgcctcaggtagaaggtagacaagatgatccaccaatttgagatttgcagtttttacaatcatctgtttactcttgttctctttgcctttgcccttcttcacctatccatctgaaagaacttctctctgctctagaaagccaagttccttggcatggtaggctgactagtacacttctaacagtgggagcaagttctatcccaattaaccggggacatttttggtaacatcactaatttgtgacttagaatatgtggacttagactccatgatttttttcaagtgactcttatttgcttcttgtgtttgacgcatttgtcacaggcacacaaaagacttcaccagcagcagagtcgaaactctccaagaattttctttaatagcttcttggcacaatagcacatgcatgatggggaggtctaaatatgtcattgctatctgctgagatgatttgcataacttgcttatgactgcttttgacagtcacgtggccttttctgaatagagcgcagcatgtttaggctcctgcatactcgcatgaatacatgagtcaccatgtgttttcagactcctcattaaatatgattgtctgacttatattacatcttccacaacatacacacactcagccattctatctgtggccttttttttttcccttgaggccctttgcaaatttagtctaacagtcatctctgaaagcatctgtattctaacttattaatgaattaaagggaaattaatacattttctaatagggtagagttgctaaatatgtagcaatctatgtggctgctgtctccaaatatttttccctatttctaagccctatagagaagtgttggaaaggatcgttgggagcattcaccccattcctgcaggaatacccctggaaatatgtaacccctgtatttctagggctgccataacaaatacccataaacttggtggcttaaaacaactcccatttattgtctcacagttctggaggctggaagtttgaaataaaggtaacagcagggccacactcctctgaaggctccaggagagggtcttctctggtctctttcagtttctagtagctctagacattccttagcttgtgggtgcataattccaatctctgcctctctcctcacatcaccttctcctctgcgtttgtgtcttctcctcctgtcttataagtgtctaaggacatctgtcattgaatttaggacccactcagataatccagaatgatctcatctcaagatcctaaacctcatgacaccttcttagatcgttttcctgtaaggtcatagtcacaggttctggggttaagacatggatatatcttttgcagggaccctcattctacccactgtatccccagctgacaaccatatacacaagctcttccaactacttatggagagatttcttgtccacttggaggctgaaatactgagcaaagtacaggcaaggagagtcagaattggcagccatcatcactaccttcatttatttctatgttcatgccacagtagtaagtgttttgtactctaaaggcctactgagttcttccagtcaacagtgtgagatatctaataagacaaaacagtaaaaaccatcatagattgcattagtaaacacatagtatcctggttaaggaagtgatcactccactgaatcctgagtcctccaaaccaaaacaggataacttcacttccaggtacgggttttcaaagggaccttaacaaactagaaggcatcctgggtagatcttttaccaccatctggactacccaggaagacaattggaagaaccaaagacaaagataaaaacaagggaggaaccacccaatgctgtctttaatttggggatgtgtgtgtcatgttttgagtaagcaaatgtgatatacgttacactgaaaggcagaacaaggccaaaggtcaaagtaacgtgggaagcactagctatttgaaaaactgaccagttctccatcagtggaagtgtttcagatagaagctggtaggtgctgtagggatcttgaaaagaggatttttctacttggtgaaaatctaagttccttaaccgatcaaaatcctatgacttctaaataaatcattttaaaacctcacatagaggtcgtcatatgggtcacatcaagagatcactactcttccttgattgacacatttgctcaggttcttctcacctggattacttcccacttgtccagatcgcatttatcattcgtgatccttcccaaggaccgtctatcccattaactttccttgattgttctgggccacatgcactctctattgtctctcctccaaagcttgtccatggctcctgtcttggggcattatacacattgccatgtattatgtattctcttgcagtgtttttacattttttttcctgtggataaactctgttttcataattagacttaaatgtattggagatgaaatggaattccctacaggaactcccacagagtttaaggccaatcccaggcatggattaggcaaagccatgacccctgtagaattgaaacacagccggaaaatgttgagaattcaaatatctttcctcatcttgtccttccctctgtaaaacttggttatctgttttaaaaaaaacaacaacaacagaaaaaaaaccatacacacataaacactttttgaaattgtttttcagctttggatgaaagaatgtcagtttgcttcttttccatacccctctgatatcagctcttcccgggatccttggtgactcctagcatgaacagagctccgaatcaatgcaaaaatactctgccttcatttgtcgttgttgttgttgttgttgttgttgttgttgttgttgttgtttgcagggggtcagttctatttcatcatgtttatggactaggaaatggaaggacatcttttctgttacagagtttttacaaacaaacccaagtatggcaccccaggggaaaggtggtaaaatctcgtcaagagaaggaacactcttctctaacctgcttatgaaaggcattccctgacttctaaaacttgcgtctaattgtctagccacttgggactcttttcgcttaaccacttcccttgtttttcccacattctgaacatctatgtcctcctttattgactccagatgtattacatggtctccctttagttcaattctcctgtaatttcttgacatgtttctgacctctttaaagaccatttaaaagggttttttttttctgtatttttgggtgtttgcaatactatacaggctaatgtcattcacagattcattaatgagtggcttagtccctcttcgagatcattgatttagaaattaagcagaagcagagctaaccacgaccttggcggcagcctgtaagcacctgcctccccactctttcctctgcagtgtatttgccccccatcatgcacacacagacacatcaccccaaacttccaacccaggttcttagtttgaagataattttattccatgtgtgactatttttatccaggtcattaatgctcctaattcttccctattacatgagagtctgtaagctaaggaatagcccacagaacactgcccatcctctgtgtatgttcatttacaattggcctttataaaattgccataagagtttgatggcacattatcgatcctgtcaagtcttactaaatttatctaaaatttaaaatgtaattgtacatttactttgtttaatacagaaagatagactttgccctaactttggcaattattttccccccagtaacctgatttaggagttacagctagggccagggcagtagttaggcagacatgcctgctgggtgaattattttagaaagagagatgaggccaccatttgaagaagtggcaggcgctggtctgtttggttcctctgtgggtatatttctgctgttcgtggtccaggatggtgtttctgactgtgatggtgatttttgcactgagctgtcaccccagtgaccagtttgaaactaagcaaccattctgccacatggagcttaatccaaattttaaagcatcatcaacaattaaaaaaaaaacaaaaaaacaaaaaatcttaagctcattttcttgaagctaaaagtaacctcagaaataatctgatatagagttagcccttgtgtgtttgaaacatgctgtaaaacaagaggttggctgaagggagtaaaatattttgaataacttttaaatgtgcaaaaattcaaagcaaacatgaatacagtagggcagagcctcacactgtttgtaaaatgtcacattccatgtggtgtccttgctggagagaactctttattacttgactgggctcgcttatgtactcatgaaacaaagctcttacaggatccggtcgttttgtgatcttttgtgagacctggccctaggttacattctttgcttctttgaagcgagtcattcctcttgccttgtgaacccttcagcaaactgttcacctgtgtgtctctgtcaagtgtaacaatcagctgaagcaacaatcaattctgaccttgggtgaagtttagtggcacacctgggaagagtttgtaattctactgttttgtcattgtagctggctggccaccaggtcaggtaaaaggaaaatatcaagatccaaaaaagtagttggtagcagagctgcatccaaaccacagttttgatattcttaggtttctaaaattaacagtgacaaggtcataattaaggtgaggcaagtgagacactcaccttcaggtgcaaaatttaaggtgcagaaaaattcagtaatcctaatgtgaatgcaatatttaaaaaaatgcaaaatgaatgcaaacaatccatgatgaacaaaagatcaaaatgtattcaaataaagacaagatcagtaagctaaagttatttagaaattgtttaagatcatcacttagttaagagaaatgatcaaacatggcaatttcctcaatcaaaaacaagatgcgtgatatggtttggctgcgtccccacccaaatctcatcttgtattgtagcttccataatccccacatgttgtgggagggacgcaaggggaggtaattgaatcatgggggcgggtttttcccatgctattcttgcgatagtgagtaagtctcatgagatatgttggttttataaagggcggttcccctgcacatgttctctcgcctgccaccatgttagacatgtttttgctcctccttcaccttccgccatgattgtgaggcttcctcagtcatatggaactgtgagtccattaaacctctttttctttataaatcacccagtcttgggtaatttcttcatagcagtatgaaaatggactaatacagtgagcaaagaggaaggtttttggaaaaaatgatgagtgtgtttcctttaaagccaggaaaacaaaactatttctaaaattgtttggagaataaataaaatatttaaacttaaattgatgttttaagttttgatatacctactcttcatgttttccacatttttcaacttccttaatgatctgaaaaaaattagccattaaaaaataaaaatgtacatatcaggacatacatttttcctttgacctcaggctgcaactgataagggtacaactgtcatggtcccgggtgaccagtatacctccttggatactttcctttttcaagtatttgtgcatcttttgggggtggggtggggacacggagcacctggagctgcaggcttcatttcctcccattgcctctccatcagttgcttgtggcctgtcactgtttaaactttttcatttatagtgaatgtcagtggaagttcttcagtatttttgtacttctgggttggaaaaattatgtctgatttatcatttgtttaaatggttttcatttcccttttcttgtgttatttactatgttggtacattttggaatgagatttatcaaagtaaaggaacgtttacaaacaaataagagagccccacattcctcagatagcaatggttctaaggattggatatacattatgagttccagtactgaactatttagccactgaagactatcttctgtttatataaatccacctaatgccactacatatttttgcattttctaagcttcattcatagccattgcttttgtttttaaaaacttcttcatttctacctttttactcgtaagatatatacctcctccaccacctccaggaattgttttctccaggcctcagggcagtgtctcctcctctacccactccagtaacagcagtagtgtgtgctattgctgcaagaaagtggatgcagtttcaggctgtctggcagtcacatcaagggaacagattccctcacttcactctggcatggagttttggagttcattctacccatacattataggagagacactgataaattggggagcttgcagaagagatttggatgtgaaagaaatactgactgaacccgaggctactcgccctgggggagaacatgggatctgtcttcaaataattaaaggacttaaaaagttaggcatattctaaagagctcctagggtaacggtggcacttgtggaaagggcaggtgaggtataggaaaggaaaattttgctcattatgtggactttttcctctattaatcaaagctatccaaaggtagaatcatctattttataaagtaataaaggcctttctcatctgtcaggcttccttttgactcagagtctgtggctatagtgtttcatctttgacaaggttaaagtgccaatgcaggacacaccgccatgtgactataaagaaggattctttttcataatatggaatcctcctcctattactagaaaactgtgactcaggcaacaatttcagagatgctttagggtcaaatcttgtcctttcaatgggaagaacacgtaaaattatcgttgccacatgccaaatgttatatttatccaattgtccttctagtggagtatgtggtttattctggcaactacatctgataaccattttctataaagccagggtgcattgaaaggagaattagcaggacaacagcacaccaaggatcccattgttctgatgagttacctgatgcagaaatgtttccacttccaaacaggctgtattccaaaggctgttcttaaatctgtctagtgcgttgacagtagacacacgatctcgaatgaccctcttggttgcaggcggcaccaactggcttttgctctggtatgtgtctttattgtcatccaggaagttcaaaatttgagaattaggcagagaagcttctatacaggttttaggctagacaataaaatcataggaaaggaagcagggattaggaccaaaaagagatgggggtttttatttttctgggtgcttttcagcactagattgggggttttggctccatatatctctaaaaatcacctctggtttctgtcctattccagatcagaaagaaggaaagggtgattcctaaggcaccacagggttatactgaaaaagtgtaagatttccaccgtacccatcatacacgtacgtaaggagggaatcaatccactccactactctttcttactctaaactgccaaaacactgtatcacagctctgtctacttacttcagttagggccagagatgctgatggctgatacattcagtaaatttatatggacacaaagctgacaggccctctctcttacttttggtgggagaaactagcttaccttttcaggcttaatgatttttgataatttcttctccattcagcagcaaggctctgatatgtctgaaaacgtgatacatcatacatgtttataagctatacactgcaaataagaaccaccagggagatattaatcatattttttaagtctacctggttctttcccttagagccaaaactgcttgttcagtcaattatctcataatctgtttctattcatgtaggctttatttagtctaaaataaagtcagaaaatatatacagcagtgtttacattaacataatattaagaatttggtttatccacatgggtaagtgccagggaattcaaattgctctcagaaagaaaaagaaaggaagggaaaagataaaagaaaattggaggtggagctaaatctgccatttttgcttactccattccattcattctgcctcagcactcagtgaaatcaaggaatctttttcttcagagatctttgacatatctacagtcatggaccccataacgacatgttggtcaatgacagactccacatatgatggtgatcccataagattaaaatactgtttttactgtaccttttctatgtttagatatataaatacttaccattgtgttacagttgcctacagtatttggtacagttacatgctgtacaggtttgcagcgtaagagccatagactacacatctatatggtgtatagtcagctataccgtgaaggtgtgtgtaagtgcactctatgatgttcacccaaggaccaaatcgcctaacaatgcacctctcagaacatatccccatcattaagcaacacatgattctacttgcaatagagcctgaagagatttaaagctttctaatttcctgggtctcttgtatttaatgagttacattattgggattctgactagccataatcaagaaagattctgggagacaaagtagggaagtaggagcagaaacttggagtcagacagcccctgcctgttttgtttctttttttggtgtgattgacaagttatttaccctctgcatttcagtttcctatgccatttgtgaggattgaataacataatatactataatataaggcccctagcacagtgcctggcgcatggtaaatattcaaagaactgttagatgaaaaaaggatttttcccaaacatcaaatcatcaaaaacaaaacaaaacataaaaacctcacttgattagcacagaatcatagaactctatttctggaagggactgttgtacacgatctagtctggtggtttgcaagttttttttaaaagctaggattctttgaccagaatattaagaggaacatgatgcattaaggaaataatggcaggcggggtgtggtggctcacatctgtaaccctagaactttgggaggctaagatgggaggattgcttgaggccagg

SEQ ID NO: 3150 - DNA, 11772 bp, Homo sapiens
cccaggtgtaagtttgaagtatctttttagctaaaatttggataaatcaaatccatttgtataaaaacaatttgaaatccagatttattgcctacaatctgaaatgcaacatatggggcacagctcccattcctttgttgctacgtgtgtgttcttcattctcttggaaaaggccccaagggtgcagaaagcagagggacacagagaaaagactccatttcacctactgcctgaacttctttgtggttctatgctatggttaggatcagagagataaggcttttgtaccaaagaaggaatttctcagctcagttgtcttcagaaaatccctgggcctagcaggcaaagatttctgttctttctagatgtctttcaaaacagtgcaatcccctaatcaaaagctctggaaacttctctacaattagaatcttctgaaattcctaagttctattcactgtccaaggtgcatacatctccacataactgtctttttgttgttgttgttgctgccttacttattttgatgaattgagcctcaataggtacatttctagaatttgtgctatttgagcccttgggaatttgtgaactattattttagaataaaaatgagcacactcagcattagaagatatcaaagggtgagacctcatttagaaaggagaagaggcagtggtctattgtcttctctacatttaattttggctttagggtactgtcaggtccatgaaagccagtagtcctgaaattggcctaactgtgcatgctcccacctcattgtcctttgaaaaagattcatataagtctttcctttttacattttatgtgctgaacttttcattatcaaatagagtgtcttgtggccttctgaaaatacttttcaaattagaggaagtttgttgttacttttctcttatgaaatagtaacaaacccttatcacacacaacacttattctgtgtgacagacacagtcctaagcactttgcatagattgctccacaatagccctgtgacaaggatactgttatcagtctcattttatagataagaaaattgcgatgcctagaggtgaagtaacaggcttggcatcacacaaacaattaggggcagggatgtgatttcaacccaagcaatgtggctcccactagtctcagagccactcaaagtgagttagacatataattagcttctgtgatctggtaccctgaggggtcagaaagacctggggctttgtattccaattgtctggagtttaattttggaactgtggtaatactataaagccattctcagttactataatggaaagaactcctttctaaagtaaaccaagcaacatatatctaggtctgtgataaataaaattgatattgtatgtttccttgaaggtaaatagagtggaaaaatatatatcgtagtatcactatagcaactgtattttgtatcagttcaagtttctgagctttaatttgaaagaatgacaaaataaggatttggaagcctgaatcaaaggaatgacattcgtattagaaagtatgaattagaatctggactaattgcaatgaagtatgaattagaatctggatgaattaattttaatatataaaaatattctaaatgaaaaccatgcatccaagagtaccatggcccatacagaaaagttgatctgctatccccaccagcacctggtcctctacaaattattatctacaaaagtggatgtcactgaagtcaaaatagaaagtcaacagatctgaaaccatggtgatgcaggaaaatgatgagtcgttccccataatcctgtgccttcttgaggtcaaggtaatattgctcccaaatgtcattcagttctgtggcatcaaaaggtacctgctatgcactaggcagagaccaccaacctctggatgggcttggaacccaagtctctaaaggtgaaaggtcacagcctcacctcacaacactgccttgggcctgtttcttattaccaaataatttccagaaggagatcaggcttgagcctgattttccagtagctgtgcaggggagaaaaagagtttggaaaggaggactgctgttctcagtgactgattgtgagaacaagagtagtgtcaggaaaaaaggccactctcccccggccctagtcacaggataaattgcagtgctcctggctgctcctcagaggaaagaggcttattggcaggagataggaggcaatgaggatccaccaactgacggaccagcaaattcccaggaccccgttcaataaagccactgacaggcacagtccccaaagaagagaggtgaaaaccacattcgtgtacctgaggtgaaagaccaccattaaaaataagtaagaaactccaaatgtgtaaatcctatataagccaaaccatatggtataaaatgaatacattttctccctctacctttggcaaaatggtttcttactggattttatatacaggaaagtattaacccaccttttgccatgtagtttctccctgatatatggcattgataatataagtagttcaatgatacttccactgtttgtgtagctctgcgtataaaaagaatgctgtgcacatagtagaagtgctaaaatcctggggtaacacctcatacattagtggccttccatggtgaacaaagtcatttttcaagcaagtcataaagtagcctaaaacacaagtgtttcagtgtttgctccaaatgaggcagtggtccggggactgccgttcatctgacatcatttctgacacagccagcgctggtttggtatctgattaggactccccgccacagtggtgccagacttactactttaagtgaggtggctgagggaaattaatgtgtcagagttaccaggaggcgagagtgtttgcttcaagtttcctttggaaagcttcagctggaattgcctttgattctttccaagagaatcttttgaagctatttatggagcttggtaataggtgaagatgagctaccaacaggaaactcagctagcatcaaaagtcaagcgtgcagatgtgcaacgatatttctagacaaaagtggtcaaattactgacttgtttagaggatgccttggggtctcctggcaagtgaagtagccattttcctcaaggctgaattttcatgatgcaccctgcacccgctgctttgttctggagaatcgtatatgccctcttgatgtcaatgtatttcccttaaaatataagtgaaatgctgcgtacttcactgatgcatgagaatattggatagaaatacccataatgtgctttgaaactttttgatgaaaagatgaggtatacttaaaagtattaactctgtaatgtgttcctttccatcccttctcaccctcttggcctaggtatacacataaaacttatcccaattcccagccctcttcacttccactttctgggaaaactatgggaactgtggatggaagattctgtggtgcatattttctttcttcaactgaagcaatgtacacaaaagaaatctataaatcttaaagtcagccagaaatatcagttgctattatctttttttgttttagaaaatatagcataagaatacatgctttggatcagacagatctggtctcaaatcctggctctgccatttactcacacatatgtacagctcaagcatgcatgtatgcattcacatacacagacattgacacatgcatgcatgagtacagtcacacactcctcatgcatatgttcaaatagatgctcactcatacatgctcacacacatgtatattcatggacactcattatatacctgaagcttaaacacacaattcacttattctttgcagttacgtatgaccagcagttctgcagctatacttgagcatgattctgtgctctccagaaggacactttattttaaatcttttatatagcacaggaagctttttctcttagtttaaaggccaacaacatcaatttgcagctagaagattgagtttaaatcccacctccactacacagtagctgtgtgaccttggataaattactaagcttgtgtatctctctctcctcatttgtaaatcgggaatttatctcacaagattgagatagatactattattattcccgacttacaaatcaggaataagccattcagaaaagtgcttggcacatagtaagtgcatgtatttatttgctattaatattaaggaatgaaactcagcacagctagaaggaagatttctgttccaacacagccttgaatgcaatttctatgtgtaaatgaaatgtatttcatgtgaaataacaaacattcagatcaggtcatcttaatactacacatgacaaagatgtatagtttaataaattttgggctttgctggtttatccacagagagggtcaggtctgtgctcaagtgtctttcagaagacatgagcatcttaggctcaaactcttcaggagatgagagtctgcagccctattaacagcctctaattgcctcaaggttcattttaagctctaattctaaaagtacaatgataggcaagtatctgccctctcagaaatcttagagactgggtggggcactaaacctgaaaggatatagagtccatgtttaatatctattctcttgagtgatatacatactcatcatacttgttagtactctatttccctcctaccaaaaactcttacatagctatatcattttgttttataattagagttgctttgagttaataaaaactatactaaaatgtttattttcttgcacgttctttttatacaattatgatgcactttagagagataaatagtgcctgaatttggaattctgggactgaacaatcagccttatgggatgtgaaaagaagagaaaggcatgagttgagtaacataagtaagcaagatttaaagaaatactaactcccaaattaacatttttggttattaattctgaattactcagcattacagcctactgtaaccttgatttccagcaggcttgaaaagagatctttcatcaactcgagtgaaactttcttttgtaaaaaataccctttgacctaggttacttcaggtctacatgacagttgaataagtacatccttgcagctttacatcttagatagaaaactatatctgtgtcttcgctcttctaaaacctgctattgaagcagtttcataagagttcataccccttcactcttcctagggagccatggagagcctgcagctgaggtactggctttcccgcagctagaagtctctagtcactttagcaactcatcacctgcttcccatttttttaaaagagtgtgaactgcttgaagttttcagataaatataataatgcctatatttacccaattaaccatttctttctttgagataccctgcctccaaaaatatttgatataaattatttttggaaaaggtttagagttttgaataaattacaattaaacagttatatttaaacaaaacttaacaaagtatataaataggaataaatgataagaatggaaataattttttaaataatctactacttatcaggtattattctttatttagattattttacttaatccctacaacaagcctgtaagtgagttacaagttgttaaggataaggaaacaaaggaattatctaaggtcattcattatatgtgtaagagatgagatttttttctagattgaagcaactaaatattctgcttttctaatatagaaatactttatgaatattttaagcatgctacttatttttagtatcattattttttaaatctagatttattaagggcttagtatgtactgtgcataatgaaaaataggattctcatttttaaagattttataatttggttggagagagaaggcacacaactcatactctcaataatcatgtcactctgtaaaccagaatgtggttgtttgtccaaataagtggggcaaataggagtaaagaaaactaggtcagtatgcatctgtggaaaacctcttggaggaaaggcaatcaaaccaggtcccaaggatgggcagcaatgtatgagaagaaggcagaagctatcaccaacctggggttggagctctgtactgtgcattcaggtgacgacagggaagctccccagcactaacaatgtgctctgatagaagagtagtgacaagtagagggatgaccagattgactaggcttgaaattccagttggagagtctggacttaatgacataagcaaagaagataatatcagaattttatgaacactaaagagtcataatgatggcagtatttaaaaatatttatgggaccaaaaaggactgtaattgactatacagtttggaggataattaggacaatttaggcttgaggtgatgaagtctggcccaaggtgatagtacacatataaagggggaaaacagaacctgaggactcattagatgtatgagatctaggggaaatgttcagtgataattgtttgatttgaagaaatagttttacaatgtatttgattacacaggagaagctatcttatctgataaaattgatactggtatttggttgtataagtgagtaagttaaaaaaggaaattactagaaaaaataatatataaatgtagattaagcatttttagttattttgaaaataataaatgctcatgcctttaccaatatttaatccaattccaagatttcctttcatgaatatgtttattgggggtctaaatcatccttttttgtgtgtgtaaatcacacacttacagcacgatttacaattccaagtgcttctttaagtgaattcaaaacttaaaaacaattccaaaacaatatgattttaaaaatttatctacattttgttttttccaacctctcaagttatatcacctgtatcacattctacagcagtcaattcagtgacttgctttactaactctttccaaagcactccttttatttttcatagaaaaaatatctttttgcactatttcattgatttatataatttctaattatatatgtataataacaagtacaactggcataaataagtttagaaaaatgcaattgactctcgatttgaagatgattcaagcagtgaccacgggagtgcatgggatcctagagcaaaagcttgtaggtggggtgggaaccctcaatggccgccaagcagcagtcactgtgttgtattcatagaatggaagcactagttcatgcagcaatccagcaaaacagagactggtgaagagcttatattgctccacagaaaacacattcctaaaagttaaaggtaattgatatttatggtagttattgtgtgcattaaaatggaacttgacatgaagtgtttctcatttcattataagagaacagcttgactttaaaaatataaacgcttcatattttctctgggggaattgttagtttaaaacacaacaaagaacaaacctaacaattcctaaacttacagcaaaaccagggctgtaagcagataagaaataattagaatgtgctattataaggtaataagtttaaaaagtatatttaagtcatagttgcactcatttcccatattcttattttgtttttgtttttgtttttgtttttgagacggagtctcgctccatcgcccaggttcatcgcaggcgcgatctcggctcactgcaagctccgcctcccaggttcacgccattctcctgcctcagccccagagtagctgggactacaggcacccgccaccacgcccagctaattttttgtatttttagtagagacggggttttaccgtgttatccaggatggtctcgatctcctgacctcgtgatccgcccgcctcggcctcccaaagtgctgggaatataggcgtgagccaccacgcccggcctcatttcccatattctttacagattaccccaaaggaacatctacttgttttttaaaaagtatgttttctcagttcttataaaattataaaatattaatttgtgaaacctactttaggaattttttacaactatcaaaaacacaaatgtgctgggtattctagtttcctaaagaagtgaagtggagccaaaaagttaccatgcactgtatttcctcgaagtcaccctaaaggtccacaaaagcaaaggctatcataaagcataatatcccaaagtttcgtctttgacttgatgcttctatatctactatgtcatctcactctcttttaaatctaagtcttccatggatatatctgaatgactgagccttggtcatgtgctggctctctagctacaatgacaggctggttaagctaatttcttgctctacatgggcatttcagacctcaaatatttaaaagttcccaagcatagggtcttaaaattatagtttataataattgtacacaacagccagtaatcagctcatgctatcacatatcaaaatgaatcattttttaagggttaaggatataagtgtgaatatcttagctcccgattttaaaatataatcaaatttaacaaagatcaaattatctaaatatcaaaaacaacataagaaaactcaagtgcattaatcattaaagattattctctacgattttatcttttaagcccctatatgtgatatccatgtcacatttagtcttttgagagattttcaaaaatccactttattgggtatgtttcattttacaagcattgggatgaccattaaacaactctttggttgctcagaaatttttaattatggcaggatggataggcatgcaatgtaacaccaaaaaatagcaattcattactttgatgacactgtacttaagaagcaagggagtttgttgctgagtactttagccgataaagcattcatttttcacctcctctcagatctcagttttggctgcctctgattccttaagtaaaattaattttgttatgtcgactatgctaccattagttgataatccaggaggcaagagatgccatgcatatttcatcattccttcgcatcacagtggttctgaacatgggctgaatatagacatcgcaggtgtgcttcgagatgactaacttaaactttagctcagaatttttaaaagctggataaattgttgacagtttgagtagaaccagtgagacgtttgggttaataattccaatttctataagggaaaatattgtcagatttaacaagattaacataaggatgttctatggtcactggattaagaattcatgtatgtttcttacattaactttgtgggaatataaattactttgggagttttagtgttctgtgtttgccccccattaggacctatgaagtccttcaggttagagatgaaatcctaaatgtctagtatgatgcttagcacagagcacgtgctcaaaacatgtgggcagaaacaggagtctaacttgcatgagggctaaatgatcccactaggaacaggatcaaagagggttttggaaggaatgatcaggccctggaatgcaggaattaagattgaaaagatgacagaaggagctttccaggagtatctcagatagacaggaagctcatttagaaataagaaataatgagatgtctgagttttatcctaggctgctgattgagttgaaggcagagtgcactaccctgttaggtgagtgcttttttggtaccactcaaatgtcctctgactcagccttgggaaaggttgtgacaagttccttgagtgaggggcattagaaaaccgaaagaaagagatagctttttccaacagacttgaaaatctggggggaaaaagtcaactggaaagcactttgggactttgacaacaagttgtaagggcagaggagagcctggagatccaccctagctacacatctttgcgataggactggccctgagggttgggcatgacattcctaatcacagtccctatacctgggattgagatgaagatagtgtcactcaccaaggggatctagacgggatgatgagtaacattagctccccatcagggctgacaagtggttgagtgaagataagtgccatgggcagcagcataaagaggtaaactgccaccaaggaggatgtgtgagccacatggaatctatctgggaatgaggatggcctttacgggaaaactccaatgtgtttctgcactcagacccaaagaccaattatattactattgcagtaaatttactcacactacgattacacaaatttattgacactacaacttagatataaagaaaaaatgtagttaacttattttgtctcccaactggtctctcaagagcacttacgggtattaagacacagagaaaaggtactttttcctgtttcccattcaaactcttggagaaagattgccttttagactgccctgtgccactctgaaacatgaccacctcaaatttggtggctccatgcaatcaggcagaagaaaaccttgatgcaacgctttcttgggctgctttagattgcacctaataaataatctggatgacaccaagaagttcccacaggtccctgggtggggctgggaaggtggatgagttgccaacgaatggacctgtcattggacctgcctcaggtaaaggtgaggtgattccacagaaggagtcaggagtgaaacgcctagcagggagctagatggagaatgaggaatggatgaggcttttttatgtgctgccctagattttcttggcctctcccatctcctttctcttttgctccttgctcacaaaagagactagctgctgtgtcttatatctcattagaaaggtgattgaatcatccttcagagtgacttaataacatttaaacaataatattatgataacatataatgaacataataaacgttatttctgagtagcccccaaagcaagatatctctttaataattaaaatttcgagataagaaaatgatgcttgcattgggaccataacataatgttttttctttgtcgtctctgcatataaaagtaatttcagtctacctgtaagagcagcatttgcattatggaagtttttgtttgtttgtttgtttttgtttgagatggagtttcacccttgttgtccagactggagtgcaatggcgcgatctcggctcccggcaacctccgtctcccaggttcaagcaattctcctgcctcagcctcccaagtagctaggattacaggcatgtgccaccacgcccggctaattttggattttgtagtagagacggggtttctccctgttggtgaagctggcctcaaactcgcgacctcaggtattcgatgagatcaggagcatgcccagctctccactgcgggcttcatgtaagaggagagccatgataatgtattgcattattcttgtacagtaatcaggtatgttgtttctctacacataagttgaatagaacagctctttttcattttcaagtttattgagtctgactctatcacctaccagtcaaataatctgcctaccatgtgttcaataactatgattcaaatcctccatgaatcacctctgggtcaatgttggggcgaaaagaaattcataaaaatggtaaattcctgtagccttccagtggttcgctctttctgtctctgacttcctttttcacttcatcgaccctgtcattagctctactttcaattcattgaggagaaaaataaaagggatggaaaaattacacacatgtgttgtggcatgtagtaatcaatgttttaggtagatactttttacgattgccctgttgaattcatgctacaactggctcctgctggtggtaagaatatagctg

SEQ ID NO: 3151 - DNA, 4893 bp, Homo sapiens
gtgtgaggtgcgcggtgtgatcgtgcgctgtgtgtgaggtgcacgctgcgtgatcgtgtgctgtgagtgaggtgcgcgccgcgtgatcgtgtgctgtgtgaggtgcgcgccgcgtgatcgtgtgctgtgtgaggtgaggtgcgcgccgcgtgattgtgcgctgtgtgagtgaggtgcgcgccgcgtgatcgtgtgctgtgtgagtgaggtgcaggccacgtgatcgtgcgctgtgtgtgtgtgaggtgcgcactgcgtgaccgtgcgctgcatgtgagtgaggtgtgcgccgcgtgatttgggaagaggcttctgcaatgggcaggcttctgggtacatcacttaattcgttcaggccggctcctacctgctgtccagtgatgaagtctccacacaggaacaggttcatgctggcgatgactatgatgtggggtatcgctgggtactcagaatccttttgtgtatcaaaagctggaatgcttcaaatttttcataagtgccttgttttccttttaacattgatctggaaacagtgctgtctgcaaagctgaggcccactcctctctgctggggatcaggggtttcagaaggcaggggccatgctgggccactgtcctgtacaagcagcctggcctccttcacgctgccagggcatctggcgcagggcatgctttctcattcatagtctgctttgaaagtcttggttttaggagaggttcaggttggtcttgctggcatcttcacctaaaatagggtctggcagacaggcccatgcgctgcatcctgcccacggcctgatagatggcctgtgaatggcttttttacattttaaaagtggttgaaaacaaattaaaaatatatttcatgacatgaaaatcatgaaattcacatttcattatctgagaataaacttttatggatgcagccatgcctgtctgtccatgtcttatctgtgtctgctttgtgctacggctgcagagtggagtggctgggactgagacggaacgccctcctcacggggccgcgtctctccaccaggaccgcggggctactctgaggctctgcttcttccccagcggggttggcttcctgctattcctcagcatcctgccttggtcctgagttggtccctctgccaagagccgtttctgtgtctcagtggatggcgcagctgccttcttgctggtaccttgactgatagactggttcctgttcacctgcccgaagtcatcccagaaatacctcttacagttgcatgggttgaacccagctccgcgtgtatttagagttttgtctcttgccccttcacccagaacagcagcacccaccaccttcccgtcccctgtgactgcctcgcaactgggtctgttctgtgagatgtcgccaccctgtttgccatctgggaggatctcactccttcaatttaatctgctctcttccgttatttttttagtttctatgtattttacttttaggacattccttggactttgttctacctctttaattgatgaagaaaatttggtcattgtatctggtttttttttttgagacagagtctcgctctgttgcccaggctggagtgcggtggcacaatctcggctcactgcaacctccacctcactgcaacctccgcctcccgggttcaagcgattctcctacctcagcctcccgagtagctggattacaggctcctgccaccacgcctggctaatttttgtatttttagtagagatggggttttgccatgtttgccaggctggtctccaactcctgacctcaggtgatcctctcgcctcgcactcccaaagtgctgggattataggtgtcagccactgcacccaatctattgtatttaattctaagcactttcttccagacggtctcactctgtcacccaggctgaagtgcagtggtgtgatctcagctcacagcagcctcaacctcccaggctcaagcagtcctcccaccttggcctcccagagtgctgggattacaggcacgagccattatgcccagcccgtctttcttcattttgattacagtgtgcgtactgtacatccgagaagtgcatgtgaaatgctggaactgggatttcagcaactgaatgcacgtgtgtgactacccacgagaagcaggacacttagcacctgctgagaagcccccacgcccatgttcccttctaggcactgcacaggcatgctggccggcctgacctcagtttccctcttgctgtggccgcttctgctccactctctgtgaggctcatccaccttgttgcctgtggttgtggattgttcattctcagtgctctgtatgccaagtactccattgtgtgaaaatcccacagcacgttcattctattatcaatgggcatttgggtagtttccacagtttggctgttaggaatagtgcagtgatgaacatgctggcacctgtcttctgttttttttttatttttagagacagggtcttgctctgttacccaggctggagtgcagtggtgtgaccttggctcgctgggcctcctgggctcaagcgatcctcccacctcagtctcctgagtagctgggactgcaggtgtgtgcctgcgtgctggctaatttttgtagtttttgtagagatggtgtcttgctctgctgcccaggctggtctcgaacttctggcctcaagcagtcctcctgccttagtttcccaaagcactgggattacaggtgtgagccactgcccccggccagcacccgtcttctggaacatttgtaagcatttctgttgggtgtgtacttgcgcgtggaattgctggctctcagttatgcacatttcttagaagatcctgccagtccttcatcccagaccccgaccccagcgtggaaaacgcagtgcatcctcaacgcctagtgtttgcggctgtggcggctcatgatcgacttggaaggcccacagtgtgtggtgtggagttttgcagggagccagtgacactgcccaccttcgatccagacctaaccttgatcctgttctctgaggccaccttaccaaaaccttgacttacccgtcttagatcacttaccctgggggaaatgtgccgcaagctcacgagggcactcagccagcctacaaaggttaccatggcagagaactgaggcctcctgccagcagccagcagcagctgaccagccgcgagggcccctccgggaaggagagctttctgtgtttcttcctgtaccccatatatgttgacgtgatacgttttactttctgatttcccttgtgagatctttggtctgtgggttatttggaagtatggtttaatttccaaacatttagggttttcctccagattttgttgttgtttctggtttctggttttaattccactgtggtctcagaatatactttgctgacttccctctctttagatttgttgagccctgttttgtgcttcatagtgggagggtgattgtatgtgcacgtgcagatatgtgtggcccccacacggtatctccagctatccgtgtcttgcctctccgtgcccagtgcacccttctcagccctgccgtgtgaccctgggctgggccctccctgtaccctcctttgcaggttggcacagtgtttggctctgtcactggaaggagctggagggactccacaggagggaggggcctgccctcctggttccagtgtgcttgcttttcctggcttccgtggtgtgtgcctgccagcctcatggtgggggcgggggctctcagtgacagtctgcaggagtttagcaacacccaggttcattcaccacggtgggaaggattcctgctaagcttccttgcctctgtccagctcccagggcgtctgcctccctcctgccccagggagagcttctgggtgagtctcgctggcactcctgccccgggcttcctgctctcaggccttggcctgctgcaccttggccaactgcaccacccggcacatcatagccccactcaggtcagagctgcgtctcagccgacgtggggttccgaggttctcaccaagatccagactcaacgcttgtgggtttgttgtctcagtcctggcggtggaggttctcccgaggcctcagcgcctccgttctcggaagtctctttacatgttagtggaaccctctgttcctgttgaatcattcttcgtgttaaatgtttctatctcttgactgatacatgatagtcatcatgtatgtattctgcggctgcttttgtttttttctctttatccctggttttctgtaatttgataagctttagggtatgtgtgtgtgttttgggggtttgtcaagatttgtaggctttgtcatttttatgcaatttggaaatattctagctattcggtctcttcccctgcctcctgcagtcccaggtactcgaatgggctgcttgctgtggactcatgggtccgtgagtctgctcatcttcttcagtttgcgtttcatttttggtagattctgtttccacgtcttcaagcccactgatcttttaagctgctgttaagctatggccattttctgtatgagccattgtgttttttcatctctataaatttggttttggtatttaaaaaaatgtcttccagctaggctggcggctcacacctgtgatcccaacactttgggaagttgaggcagggggattgcttgagcccaggagtttgagactagcctgggcaatacagtgagacctcatctttaaaaataattaaaaaggtcaggtgcggtggctcacgcctgtaatcccagcattttgggaggacagtggatcacaaggttaggagtttgagaccagcttggccaatatggtgaaaccctgtctctactaaaaatataaaaaattagctgggcacatgcctgttgtcccagttatttgagag

SEQ ID NO: 3152 - DNA, 4183 bp, Homo sapiens
gttccctacccgttaattagccaggccgctgcccacattgtcacaaacattatattaactgaaaaactggcccatgccatattccattatgagaaattattttaaattcgattaaattccaatgtttattcagaaaacctggtagagattgaattgctctatgtacctttcttagttttcttcttcatagcatattttgaccatttatcttctacacctggctgacctgcatggtccttgtagtgtaacttctacttggtgtttgcgctttgctttgttttcaaatttaaattgtgagatacatttttaaacctatctaagaaatagccctgatattgaaatggcttctgtggaataggtttgacagatgtaagtctttgattctttggctttggtttttgtgcttgttacagttttacacacattcattcagaggaagacattaccatcaatgtgttgtttcttttttcaaattccagtatgtttttaaagacccatatttcactaagcagtgtacttgttgaaactgatgtgagtgactttatgtttccacatgtgatagagcatcagatactggagtttgccaggggtagaatggttggattcaggaatgtttagctgactcatagcaggaagttacactgtaaaaaaatgaagcaaggcagggaagacagatttaagtaccatgcagctcaaaacgacaactacattgtcattttcattgtgaatacttttaggttctatattggctgtgatctttgtactaactggtattatggagaatgtgttggcatcgcagaaaaggaggctaagaaaatggatgtgtacatctgtaatgattgtaaacaggcacaagagggcagcagtgaggaattgtactgtatctgcagaacaccttatgatgagtcacagtgagttctgataagagcatcacatttaataatttaggaagccaaattgctctgactggttacttatttactttaaaataaaaagcagattttttctacatttgttatacacttacgttacaaattccttttcattttttttttctctttttccctttttacctacccttcaaaatttatcttgcttcatagtgaatgtttgagacacattggggaaaatgtggtttaatggtagatttgattcttcaatatgtaacatagaaattaatgagattaaaatagcctgacttgtttggactttatcagtgtttgaaatggtgctttattgcaggttagaaaaacactaatttgggtataagctttgagactctgttattaccttacaggattttgaactcccatatggtacagtactagttgaaagatttgtgacttgttttcagctttaaaatcaattgaatgtttcatatttatctttaaattggttctccaaaattacagtgttcttataaatttttttactgcttgttcttaacatcaaaaatactaaattaatgtactggaatgtcgatcttgaaagtattaaaaccataatactaaaactattttatatcccagggtttagcaaattttcaggtgcatgctttattataagtaacatcatcccatctgttttgaactcacatttccatttcagatcttgcagattttttattggccgtgatcggtgtcagaattggtaccatgggtgctgcattggcatcttgcaaagtgaggcagagctcattgatgagtatgtctgtccacagtgccagtcaacagaggatgccatgacagtgctcacaccactaacagagaaggatgatgaggagttgaagagggtgctccgttccttacagatgagagcccctctgtgtgcagcatttgaaaatgaaatcagccggcataattttggaagcatttctaggatttcaagtttccaatgttaggatttcaagtttccaatcttagagtgattatttactgactctcagctagtctagtgaagggcttgacaaacttcagtccttcacataccagtgtcatgagctttatcatatccccacaccacctcagcttatctaacactcagataatctaacgtgactcacttctttatacattttatttttaaagaaacttcctctcactcccatggattgagaaacagtatgattagattatagttattattttccttatgaaagacagaaagggggctgggtacgggggctcacacctgtaatcccagcactttggggggctgaggtgggcaaatcatgaggtcaggagtttgagaccagactggccaacatggtgaaaccccatctctactaaaaatacaaaaaactagccgggtgtggtggcgtgagcctgtaatcccagctactagggaggctgaggcaggagaatcgcttgaacacaggaagcagaggttgcagtgagccaagatagagccatggcactccagctcgggtgacagtgcgagactctgtctcaaaaaaaaaaaaaggaaagaaaagaaaaacaggataggtatggtttgcaggattagcaagtgatacagatgtattgaagacatagaaggccagtgtggttgctcacccctataatcccagcactttgggaggccaaggcaggaggatcacttgagtcacttagttagagaccaatctgggcaacaaagtgagaccccatctctacaaaaaataaaaataaaaaattagctgggcatgttggcacgcacttgtttatccagctactcgggaggctgaggtgagaggatcacttgagcacaggaggctacagtgagctatgatcgtgccactccactccagcctggatgacagagcgagaccctgtctcaaaacaatggggggaaataaaaggatatagtgcattggattgaaactttctcctatttttatcataatcacaagaattgaagaaactaaaaagggaatcgtagtctcaatgtgtggttgaatgttatctaacatcacatctctgccacctcatcattaatcagctgtggtaatgattccacactttgaacccatcccacctgtttacagaagcagttgcaatgccagcatcactcagtgacagctcaccatgtagggcccagaatactgcttttgtgacttctaaacttgtgttccaccccccacactgtggggaaaagaaagagagatcagattgttactgtgtctgtgtagaaagaagtagacataggagactccattttgttctgtactaagaaaaattcttctgccttgagatgctgttaatttataaccttacccccaaccccgtgctctctgagacatgtgctgtgtcaactcagggttaaatgaattaagggctgtgcaagatgtgctttgttaaacagatgcttgaaggcagcatgctccttaagagtcatcaccactccctaatctcaagtgcccagggacacaaccactgtggaaggccgcagggacctctgcctaggaaagccagagacctttgttcacgtgtttatctgctgaccttctctccactattatcccatgaccctgccacatccccctctccgagaaacacccaagaatgatcaataaatacaaagggaactcagaggccggcagcatcctccatatgctgaatgcaggtaccctgggcccccttatttctttctctatactttgtgtctttttcttttccaagtctctcgttccacttaacgagaaacacccacaggtgtggaggggcaacccaccccttcaccacaccaaggtcttccgaccaggctttgagtaccattattgcaaaggaagctcatcttaggtaacttattactagagcagaaatcacctaatgtaaagtatttcatgtatcgcatttaaaactgacttttgggttcattgatgtagtgactcaactgggaatcttaaatggaattagtgttttcactgacaataagaatgcctactttttcattataggcccataagatgtcccggcctttccttgaaccagtagaccctaatgatgcaccagattattatggtgttattaaggaacctatggattgacctttgtaaagaagaaaaacatgttagaagaaaaatggaaaagaactctgcatgccctcagctcagatgccatctcctctgggagctcctctggcccctgccaaggctggatcagatgccctcagggcacacacgatgctgatccagggccatctg

SEQ ID NO: 3153 - DNA, 4557 bp, Homo sapiens
ggcgtgtgcgcccaaggccagaggcacccgaggtgggctggcccagggtggaaagcctgggccgagcccctggagcgggcggaacggcgagccagattcaggaagttgtgcctgtgacatcaggggcaggacagagttggagcgaaacctcaactatgccaggcgtcggcccgtaggaaggcagggaacacagagggcgctgccctcggcggcagcggcagactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcaaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatatactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtaagtgtgtgtacactgttcaatatggttcaatatggtaccaatagccacatgtgactatttaaattcattgcaatgaaataaaattaaaggtatactagctc

SEQ ID NO: 3154 - DNA, 17401 bp, Homo sapiens
tgctatgttacctaggctggtctcaaactcctggcctcaagtgatcctcccgccacacctggcccttactttaaagtttttaaacacaccgtcagtaaaacatttttaatagttgaaggagaaaaataaatgtttcctctaccatgattcggccaaatgcctgtcagggaaaaatccatctgactacatcttttcacgagtcattcctatatcttgccaacacatcatagaatataggtcagtgatgcttttccttttctttcatgagtgtgatttcatcgtctgtttcattcataggaggcaagtctcatatgctgactgaaacgatagactttctgtgctttgctttttaacatcagcttgggtttcttcccttacctaaccacgtccttccctatccccatcacctcctccctctctggcccagcaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcaggtgcagcccacggtgtctttccccgcgactcaaaggccctctgctccacgggcatttccggccctgacaggcacttgttgacctaagcagtgataccacacacttagtccacagaggagccgcagccccactcctcgagttttattaattccaggacaccctgcaaaacaaaattaaccattcagttttcaatcaatttgcccacaaagctctgagaaggggggacctaccccactaagttgtaggggtgggagaacaggctttaatccgacagagatccaaaccatggttcagcaattacttgctaggcttaactctctggctctcagtttcttcctctacagaatgggaataataactttatagagttgttacgttaggagcaataaacaaactaatgtctccaaagcagttgcccagtgcctggcccataacaaaccttcagctgaaaaggagcttttcattaattatattcactaggttgagggggttgccttggcttatacttgattatctctatttttgtttcatggaagaaagaaaggttgatggtcattatgtagctctgaaagaaaaggcatgttttcatctcatttgccaactcaccaagatttgaatcttgcttaatttttgctttttatgaatgtcttaactggggagattttataatgaggcccagaagtgtctgggagtgtctaagaggaaaggaaggaactctagtacccaggcttctccaatagactttatagattataatgatgcagttcagagcatttgttctaatgttaaaaatatgtgcactatttatcagcagaaaaaaaaaaaggcaagtaaatagacatgtatgcaacccacagtccagggatagcattaagagttgtggattatactccagtgcttccagaagctgagagaatggccaaagagagtggggcagggaggaaattaccctacatagtgagactgcattttaagagttcatggggtccgggcgcagtggcctacacctgtaatcccagcactctgggaggctgatcactttgggaggtggctggatcacttgaggtcaggagtttgagaccagcctggccaaggtgcagaaaccccgtctctactaaaaacacaaaaaaaaattgccaggtgtggtggtgcattcctgtagtcccagctactcaggaggctgaagcaggagaatggcttgaatgcaggagggagaggctgtagtgagccaagatcgcaccacggtactccagcctgggcaacagggtgagactgtctcaaaaaaataaataaaaagagttaatgactaggcattggtaggtcacttttatcttcttcccacacctagttctctgtgcatccttagaaaggaacagttagggtgccaaaccccaaagcctttgcatatccagtttcattaaatggagatggcttggggtttccagtgtacaaattgaaagtatataaggaaagcatgtgttgtatgagggcctgaatttcataatttatggatgttcatttttccccctaaatgtgtcattctttttgtgatagacatgatgagaaagaaactgggaaacatatagcagatgtgaggaaaataagataatgattcccccactaacttgtatgccgcgggaagattgggactgtctcttactactccctccgcccactatctatctatctgctgtttatagtgtagtgtctacactcagtaacttatttgttgaataaatgaatgggttcccctgtttatagtatagtgtctacactcagtaaccatttgttaaataaatgaatgaattcctcatagctggagtgtctaagaattggctgcttgaccacttggcaaggatgtgattgcagggagtcaagccaccagagaaatggctggactcaaccacctttaaagccacttgtagaatctgacaggcacagtagtatctgaaaaacttttaggtagaatgtggttaagcatttttcttttttgagacttgtctcaaaaaagacagacctcactccattgcccaggctggagggcagcttactgcaaccttgacctcctggactcaagtgttcctcccacctcagcctcccaaggtgcacaccgccatgcctggctaattttttttctctagagacaaggtcttattatcttgcccaggctggtctcaaactcccaggctcaagcaaccctcccacctcggcctacaaaagtgttgggattataggtgtgagccactatgcccagccaagcatttttaacattaataatcatattttaattttgatgtgtattgaaaaatataattagaagatcaaatctgcagtttcaaagatattagtaagaaggctaaatcattcaaaattgagttaatttgcacaaacatgttaagtaaataaaagttcttgtatatgtgaacctagtaaatattaccgcagtggttctgcaataactgaagtggggggaatcccaggaatttgccaccatctctgaggtctgcagaaggatgatgcaaacatgtaggttttctcaatcttggccctattgacttccgggcttgatcattctttgttgtgccctgtgcattgcaggctatttagcagcatccttggcctttacccactatatgtcaggagcacatcttccaactatgacaaccaaagagtctccagacattgccaaatgtcccctggtggtggttgggaagggaggttgggtggcaaagtcagccttagttgtaaaccactgcttagatgaaggagccaaaaatagccagctggcacatatcagctgccaaggctttaaatcagttttaactaaaatgagtctttgcagaattccttcagggtattgactgtgatcctaatgcatgcaaacatggaaggatcatagcagagagccaggaaagtaaagatgtccacagactttgaggccagaggtgttcgtgacttggcatatgcgtatttatgattgcttttacagaacatacaaggtaaatttacccttcgctagaccctaatgcactgattttttttcacatttctttagagccaaatggctaaggaaaaaaagaaactagaactctagctcccaaaaccagaaaaaaagatcctactgagttcatgtaacaggcaccaatatcttttggtagttaaaacagtacccaaaaaagggacagtctctgaacagactaaattgttgatattttccaaccactgctttgccttggagggacagaagccacaaccacccagtgttctctgtgaagctgagtgtcctgcatcaggccccgggatgctggagaggatgctgcagattccgctacctttgaatgaccctttccctctcactggacctttgtcaaaagaaaaaggtgtctctcttgaggctggaccagtgagccaaattttaagtaaacagaaatggaaggtgctaagcaaacaaactccagccaaatggaatatccaaggtctggatggccagctgccacttttgagttgttttccagcgtagaaccctctagttaggctgcagcatttcagattggaaaaaccagacctaagaaaacaaaatcaaactcccagacttcatttcctagtctcacaacacatctctgcccaagaggtcaaaaaaggtataggaattggggaaaatattagaaaccacctaatctgacattttgtggagaaagaaactgaggttagggaaatggggggtcttccctaatgtcacacaacaagtaggtggcagaatgaggactcagggaagtctcctgttgacctaacccacttctttgtgatcttctattttagaaactccgtaagccaaagaaatccatgttcttttttctgataccaagggactaagatcagctctaaattcatcgactgctgatgtggtactcagtagaacgtctgtgttcagtagaggatatggaaatcatctggtcacccatggaaataattgcttttcttttttagtgcaaagacacatggtctaagttgctgctgaaattttggacacatgagcccaggtctgggacttggcaagcgaataggccagatgggaactgttgcttgacaaattgaaagttctttgtttcagagtgaaccaaacctggtctcagctaatctaccaaaacaaaaaagctgggggagggtatattgtagagcccattttgataattatttttttggcacaaactactgcttacaccaaaaagcattgtggatttatcatataaataatgacatccccaaagctgaacactgcaaatgtagctattagggacttgttggagtgcttgctgaaagtatgtttttgtagtattgaatatctctgtggcgtgctgcttcatcccaaggcaaactatgggtttaaaaatagatcagtccaactggatcttacagtcgctaaacagctaactgctttagaggagcaaactcaaattcgtttagaaaaatgaaaaaatgaagagttgatttccaccagacaatcaatacatattattaataccttgtatttacaaaatacttttatattaagacctaaaactctgattataaccttcataggggaatacaaaatggtgattttcctcaatttataaagcaaggtaattcagagtaagaaaatgcctccagaaggcctggtttttatttccctactagacttccaggccacatttgatttcttgtatgcattttgaaacatttgctatctggttgttctcttccaaaatgaattcaaggtgattccacttacgttcccttgaaaagcgtttttacttaaaatatagtctagtatttgtgcatttcctacactaatcagtctttcactatggaatccttaagatgattatgcatgtgcacagcacacaattcattcttctttctctaggatagtgattcttgacctttcttaagccaaaggccccttatgaaatataatgaaggctccgtagatgctctctcagtaatatggacacataaatggacatagaaaattttgctctaaaatgaaactataaatgttgctttggaatctgccctactaagatttagaagcataagaggtgctagaactggctcccttatgaaagataagacctgaattataagcatatttgagcatattgaaagtagctaagtaatgaataaaagtcaagatggactctttcattggataattgggtaatttgctttctcaatagaaggtgacacagaattgcttgtagaataaaaaaaaattctttctggaaggaactttctggaagtagttcaaccatcgtgttttatacttggttggcatggcagcttgggaactcaaaccctattattctcaactctcaagtgagagttccttttcctactggatgctgccccatgaatttctatggcttatgtggttattaggcctttatttagtccttgcagcatcatagttatatgtatatggataaacaagaagctgattgcccttctctactgaggacattaattggtgttcattttcccacaataacatggctaaataagtattaacatgttacattaagaaatatgtcctgccaggcacagtggctcatgcctgtaatcccagcacttggggaggctgaggctggagaatcacttgaggccaggagttcaagagcagcctgggcaaaatagctacaccccatctttgcaaaacattttttaaaattaggtgggcattgtggcacatgtctctagtccctgctactcagaaggctgaggtgggaggattgcttgagcccaggaggtagaggctgcagtgaactatgatggtgccactgtagtccagcctggacgacatagcaagaccctgtctctataacaataaaaaagaaaaaaagaatatgttcatattcacatatatctttaaatgatggtcagttgtctcaatattctcagggttctgcatttttacagatcctcacaacactcaggcctttggtctctgtacttacaacatattgctttattaataaagtgttttgctgttcatagactaaatgccaccaaagtcatatactttgtatggggttttggtgataggccagggcaccacatgtgctgactagtgctctttttatagtaaaacagacttatgaaagcaaaaatttattgtgaaactgtttggggcatgccaaatatcataggcagttagctctttgctaactgtagaaacccagagaatagaattgagtgttttcttagggaaggggcaatgaacactttgtgcctgggagatcgaatgctgccaagaaagggtttcattgcccaggacatagtgggggaagaaatggagactaaattcaacctctccaagatggccacaggcaggggtgttttttcttccaaaagtataagaaagcaagagaacccagttttgtttttaatacttttcttgtttgttttctaggtagaaaagtgtggattcactagaaattagaacttgattccattttctaagatccattgtctacattatctgcagctgagagcttctactcagggggcaaggtgtctagcagtttcgatttcagaaaagtgttatttctgtagtctaaatgcaaataatatgacatttccttctgaagcaaatatatacgcacacacacacacacacacacacacacacataaacacatctctgtttcctttcttggtttttgtttggttgtttttttttaaccagagattgccttcatttgatggtctagaagtgactttcttttatatgtgctattttgagcagaaggagaactgagaaaaagaaggaaggccatctgaatttagataggtgtaaagtcaaagaggaagaagttagtgtttaaggctaaaataaattgtcctgtaagttatcccactgaccttggaattgacagggtcacttttggtttccacagagccccttatcaatcacattcatttggagttgggaggtacaatttgccttcttgtatgttctgagatgtaagagcaattttcttgtttgattaagtgatttattcatcattaaggctaatttcccaaatagtcatttttattttgtaaaaataaagtttggaagagaaagggaatgagatgagatttgtagatgagatttttattattttgtcattgttttattttattatttttgttattaatgttactcaatatgtggttgcttataatttatttcaccaagaaatttagaaatgggagatattccttaaaacagatttcaattttttttagcgcaacttctagaatcccaaacatactttcctaggtgataaatacatggctgaaaagccaagttcatattgaaagtgtaggtacaacttaatgacagcaatgttaatcgtccttttcggtgtgcatgcattttttaagtctcctacatgtgaggtataatgcctggcagccacaaataaaccttgaccaaagagaggatattattgatcacaatttttaagtggcttattcaagatagtgctacatttacgttcacttttatcaagtggaagcatctcggagctaccatctattttatgtttatatttgtagacaatgggtgccaagttcattattctacaaagctatgagcatgcctttgtgaattaatattaacagataaagtagagatccgaggcacttacatgagtaaataagaagaaaaccccacaccatccacaatatcctgatattgaggggggaaagagtattttatagaccgaaattgaccaaataatcaatgaactcaatcaaattaattcaatcatggcccaaaacttcattgcctccttgccaccctgagctgacatcatccacctgcagctgaccaacatgtgtactgtatgcttccatacctcctgctcagtgggcatcaggcaggtagatgtgctctgctcaacagtatcccatgaacagtaattgagtaggagatggtggggagagcagggattcatgactgaaggtcaatttattttcagatattctttttagattgagcaacacagacttcttttggaaaatctgatggtagatgagtcagcttattctgattgcatttcaggtggaagccacaaatcctaccacataattctgcccaatgtgcgcctcatattcacattctcaattggatgtaaacctgagcttgtgaaggttacaatagttaaatgtattaagtccttattatgtgctgggtattgttctgtttcccatctattactgtatttaatcctcatagtaacacaaataatgtactcttcttatccccatcttataacgaggttgctggagctcagctgggttatgtaatctacctagggtcacacagtcagtgtggagtaaggattctcacctggcttcggttcccatcacctaagggtgtggtctagccttttaataaggttcagctcttgagttaaaacctaagctctgcagaaagcccctgggaaatgtgagggccaaattaaaggtaagctacaaactttcaggtgaaccacattaaataatattcttaatgtcatttagacataatggaagagtttgccagttttgttgttgaaagtgcacagggctgtgggtttgtatcctctggtcttctcaacatggttttaatacatatctcttttagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccaagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaaaaaaaaaaaaagcaaacctccaaaacgtggacctaaccattgcttcacttacacttcacccacagctggagttcattcaactcttgcttttcacaaaatagtaaccaggagatgtttaatgtgcctgatttaatgtttttaataatcacagcaaatgaaaggtggtttagttataagtgaagcatggttgaataccagctggggagacactagggaagggagctttgtaagccttgattgcgaaagtccaaattttgatgtggggctataacatgacacccttggattgcgactggttttatacggcctgcctataacgttgaaaatccatgtactacataataattcagaagggctctattcactacacagattacattgttcaatcatcagctgctaatagcctaagatttatttttttttttttcttaagcctatggaaccggctttgctgttctggggggtgaaaatagactaactactggagaaacaaagagagaaagaaaacccagtgtttccataggggcacttttagccttcccacaacagttaagcactctttgactgctgaaggaaccccatggatgaggtgcaggctacttcactctttttttttcttttttgagacagagtctcacctattgcccagactgaagtgcagtggtgcgatcatggatcactgcagcagcatcctccgagttcaagctatccttccacctccgcctcctgagtagctgggaccacaggttcacataaccatgcctggctaatttatttttacttttattttaaaataaaagatgaggtctgtcttatgttgcccaggctggtctcaaactatcctacttcttcctcccaaagtgttgggattataggtgtgagccactgcacccagcctacttcactcttctgaattattctgatttattttcaacaacttttgtgaacttgcccgtgatacaaagcagatagtccctgaaccacagtcgtgcctccttgaaacaagccattctactgtgctaatgttttaatatcacatctcacaaataacaggggtgaatgtttctctctagcaatctaggcaggtgctggtgtttcatctccatttgaatgcttgacctcttaatgtgtgtgtgtgtgtgtgtgtgtgtgtgtgtgttcatgggttttaaaagaacagtattttacaaaaggtgtagcttttataagagtgcagaaaagggaaggatgtgtttttttctctcactatagtataagaatctattttggagaaaaaaagaaaatatgagggtctcgaagcatgatttttatataactagtttcagttttatctaataacttactttttaaatcaatatttatcaacaatctttccttgtatgcagtgctttcaaaagatggttttgagtgtccagtgaaacttatgacttggatatatggttgaagaatcaaaacaaaagcaaaaaaaaaaagcaaaaaaagaaaagagaaaaaaagaaaaaatgcaaatggaataattttctattatattttagacaaacatatcattttcgagtattttaaatactgaattcatagttgttgttttttaaattccaacagtaacagctgaatggtttaatctgactggcttcctaagaaatgtttaagactcagctttaaaaagaagttaacattcatatctctgttttgaaatcaaaaatcatatttcaaaattctttcctaggaccatctatgtgtctcccctcccctccacaaaaaggagaaagagtgcattaaaatgtttagttgggttttttaatttttaatttttatgttatgttttgctttgttttaagtaaacaaaaatttttctttctttactgcatgcatagcacttaataaaatggatttttaaaaaatccactagtaatatcagaatgtccagggagtgactgtcactacaatgatggtttagtttacttctgttccaccttttgattgaaatatttagttgttaggctgaaagcctcggcagttaagaacttgcctgagttttcttcgttcagcaacttgacagtttgactgatgtgcattatatatagctcaattatgtctgttttttatgctaagtaggaaaaccaaccacacacattagcaaaccggcctcaacatataattagaataaactgtcttcttgttctactcagggcctttaggtgtgttcattcacggtatggaaatacagtaaatgaaagattccaactagttgtcagtgcttcttgaaattccaaacagaaagatacattggtcaaatccaacacttggcttatcaatattaagtcttttacctaaaggcccagccgtcaccagacaacagaataatcaatctgcctgaaaatccctcctccttgtcctacactttttgcctgtttgggagaatatctttgtactccattctcctccctcagccagttactgggtcacccatccatgtgttcatgaatcaatcatcacggcctgcagagcacctgtcctaaggagggaaaatcctgtcacactgcctctccccattcgtgtgtggttttcttgatcggtgagatctgtctctgaagtcactgccagcctccctgggaacgtctatagtgcctcccctgccttatgtgatgggagttaacaactcagataagtacacctgagagcatttctatcaggtaaactgtcacttaaatggaggtgtccacatcttaattgtttctccttgacacatttctcaatccacgaagccaggagaggtagagtgaaaatcccagccatggatgaatgtactaatttgaaagccaagtgttaagtcggatgttttcccgttacactactactcagccctctcctgcggccacatcaacggatgcaagtcacagtcttaacacagcctgtgggagacaagcagtttgtgtgctcacagtatatattatagtaattagggtgacttagagcaaatactcttcagatcctatgtagtcagtgaaacaaaatggagagcgtattctgatagaaggacgtcgacggtgaatgttctggtggttgttgcctgttaagtaaactttagtgtgtaagttgagtttgtcattaaaatcataaaccagctgcggtaacagacaagcctttggctggggagttttaagcctcggtaactgctataaaactagccatccagttaggatagaatgtgtttctttctggttaaaaaaaggaaaaaccatctaagaaaatatatatgtatgtatgtgtgtatacagtggaattcaaaggaccaaagcaaaatttgaacaggaatctattaatttagaattttataagatatttattaataaatgttatttttaaacattccatttgaacagtattctgtaggatctacttgtttttaaagtgttagtccataataaactactatagttatgtgtattttcatttttcagggtttcaaatggctattctccatcatttggtggaaatgtttgcttagatctctgtgcatagacatttcaaggatttttattgctctgtgagttattttttaatcaacattctgaacagttttttttaaacatttatttctgtgtgttcatttttaaagtaagctctttcatttaggaagcagagttcagctaaagggaatcagtaactctaactggaacagctttcttgtagaagtgtaaaaacagcttcatctctgcctctctccaccccaccccaatttcctagaaagccttgcactattcagctcccttagtgctttttgtcccttcccgaacaatatgcagtagctttaagccattcaagctccattatgcagtatatctgagaagggaaaggaaacaacccatttaaatttgaataaaaccgtgcctatgcgaacagtagcaatttagaatctcttttctgcttttaaaataatttatatttaaaaattgcactttagctttttgatccctttgtatttctcttattctctttctaacctcttctctgtcctcaaacttgcctttgctctcctttacaataccccccacccctcctccaaggctctgagcggcatcatttaaaatactttacagatatttgcaccaggtacatttatgtgcgtccattggtagcacagctgagacctgtgtctcacatcagcctaggtgaagcctactacaagaatgccaaggagaagagccagtacactatatggtttatactctttatccctttattcatagcatgttttttaaaaatgttatattatgcaacagatgtgaggcagcagctaagctatacttaagaattttctctcaccttccaaaccaaagtgtcctgaataagccaggagacttattcttttgtgcaccctggtgcacatctgactgttgtcctagccatagactctctgaggccactgaaagaacagtggccctatcgatttcattcctaggtctcaaaaatacaatgttgccttgtaacataattagggacagcacctctatttcacaattataatctaaggtaggataagacgacacagcagcaataaacttacaagtaaaattcaataccaaaacaaacacaaagaaatttaaaaaacaaaaaacctagctcatcatgttgtgaaaatgaaaaagtgaatgtccattcaaaatattttactatttcttgtggagtttttcagtgatgtaatgcttgtagccaaattgcttaaagagtgtttatatatttttttccttataaattgtctattttttaaaaaagctatttaaccacagctgaagtggggggtaaggccaaattgccaacacttgttaaaagattaatactcttaagtggcactctgatacctttccaacttgtcatcagaaaggaatcaataattaccaactgttgtatttagaccaacttacaatatctagctcattagaagccaggatctagaaagctccttctaagccatttaagatattcttacattgagcttcatattatagaactttataggattggatattttacaatagaataatttagcctcaggactgagaatgtggaagctgaataaattagctttaaatacatcattaaaatcttatgcacaataagctcattagattctagttttctcctttagaataccaatgccacagacactacaggagataatgaaaggtatcagttgtgttgagtggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaaatacaatgttctaggacaattggaatataaatattgtccaaaaatataattaaaagaaaaaagtttagcactgtgtaaagtaagtgttaactgaggaagtcccaaaaaggtgctgtcactttaagttctggacttggggttctttgtatttgtaaacagcaaagcatttgtgtttgtttgtctatttgtaaagcaaccaccttccttattggaaggagaaaaaaaggggtacatacatgtaaatacttgctgcagcatttaatatgtttaattttgtgttaagctttttgttgcatcgtgaacacatttattgttaccaatggacaatgagttcattaagactgttcaactaggtcagatttttacatctctttctagcaagaagagacaagattttgtgcatttgtacaaatgttaatatcactgcaattccaatataataaagcactcaaatgcaaataatatatgtcacctttgtatgatgaaatttggggttgggggtaatgacatctattcctcacatagtcttgtcagaggcatgtgaaccagagcaactccatcttgaataggagctgggtaaaataaggctgagacctactgggctgcattcccagaaggttaaggcattctaagtcagtggatgagataggttggcccaagatacaggtcataaagacctttctgataaaacggtttgcagtaatgaagccagctaaatcccaccaaaaccaagatggtgacaagagtgacctctggtcgtcctcactgctacactcccaccagcgccatgacagtttacgaatgccatggcaacgacaggaagttaccctatatggtctaaaaaggggaggcatgaataatccaccccttgtttagcatatcatcaagaaataaccacaaaaacgggcaaccagcagccctcggggctgctctgtctatggagtagccattctttctttcctttactttcttaataaacttgctttcactttacggatttgccctgaattctttcttgcaggagctcaagaacccactcttggggtctggaccgggacccctttccgataacagtctcattcatgacttataaaccaaggcttaccttttcagggtcaccattatctagggacaaaaggagatcagattttctccttcccagaccagcactacattcccactgcctcttccatccaacttcccaactgaggtcactaatccagcatattcacagtgggttggccatacaacttaatttcactttaagtgagtttggaattagcagattttaacagtcaagaaataaaggcagcctaaggtcatgttccagccgtgtctaggaaccaagaatcacgtgctggcttctcggacaatcaaatcctggggttctttgcttgatctccagaggagtcccaagggtagtcttagtccttttatgtgttcctttagatattgcccttcctttcttcctcctcttgcttttatttctttttctttttttagtcattctccttttcctctaacactcgatatctgatccatcagcaagatcagaatccaaccatcatgtagcaccaatcttaaagttatgccctgaccaagccatcaacatctcccacctggattattacaataatcttctaactggcaaccagagggag

SEQ ID NO: 3155 - DNA, 4818 bp, Homo sapiens
atcatctcctcttttgacattcatattgacatttaaattaatgttaaagtcagatgcagtggctcactcctgtaatcccagcactttgggaggccgagactggaggattgcttgagcccaggagttgaagaccagcctgggcaccgtagggagactccatctctacaaaaaataaaataattatctgggcatggtggtgagcacctgtggttctagctactcaggaggctgaggtgggaggattgcttgagcctaggaggtcaaggctgcagtgaaccataattgcaccactgcaatcctgagcaacacggtgagaccctgtcttagtaaatgaatgaatcaatgaatgactagataaatagataaataaattaataaataaatgttaagatcctatttgtgatagtggaaaattctcattttttttctaactttaatgggagtgtctttagtactccatcattaaggatacaaatatccgctagtgtctgttaaaattaagttttataactacactatcccatattatgtcccactatgaacatgtatatattttaaaaagtacagcatgtgtttagaaacagagatagatatgattaacaaacatacacaaatatatggggttaacagagatattggatatttatttttatgaagatacatgccacacttttatattgcagacttatgtacacgtgtattggtaaattgtttttaataggggattaagaccatagaataaaatggtactccttcatccagccatcatttatccatctctgcatcatccctctatctatccagttgataaatatctcccatttacctaataagtgttgagcactgagctaggttatcagaaacaaacacctcctaaaactttttaacttctggaaggctaaaatgtgcgtaattttgtctttcatagcaaatttccttttttatggacctacttcagcattcatacacaggcactttttttcttcaccaaagcattgagggcaatttctcaaatagtaacaaataaataggaaacttaaatcttagcagttgacactgcataatttttcccggattttcatcaaattttaaccatgtaattttatttacctataattcaagagattcattgtctttttaataggaaaaaatctgtcagtcagggaaattcataatgtccatagagagacgttaaatttgtcattgtaaagacaaaattaactatatattaatctatcatctgtttccctagctcaatctaatttgacatatttaatgaaaatcactgatggcttctagtataataaactgatctttaaaacaaaacatagaaattctaatactcacatatttcacattgaaagagtgatgaaaacttcacttgaaacatttattttgtgatttcaaaaactgtagttaaaatgatagctagggagcagtaaatcaccatatgctacgctacttctaggcttggactcagaaccttgaacgttgacagaattaacatattaatttgagttttccctggatgtttcagtttaacttttgatattcttctttccaaaggctgaaaaaaaaagcctttcatttaaaatgcatttcttagagaactgttaatgatctcccttcctttcatttagcaggcaaaataacatttctttgaaaaatggttatctgctgagaatttgattattgaataaagatcagtaattttggggtgtgtggaacatctgtcaggaattttggaaaggaatcactgactccattcatgtgacttatttcatatgaaagcagcatacacattatatcagagaggacagctaaagctatatcaacacagtgccgtaaattcagagggaagaactggagaacttgtggtagcatccatccagcatgacatcattctttgctccctccactctttgcaagaagccctttctcatgaccatccataatgtgcggtagtgatcgtattatttctttcttcactaatcttcggcaacttttcaaggcctatgagataaaatccagatgcctagagttagcatttaaagccctgtgctgtggcctaactcatgtctccaatctcagctcctgctacttatgcaccttctctaaactttcttctggcagctgcaaactcttacctcaccctgggcatgtccacacgttattctgcctccaagcccttgcttcctctgcctcgaattcccttctcagattttccatgtcacttgcccagatcgactgtaaaacatttcctgatccttccacctagatgtgatcaactacatgtacttacttttatatattttcatatacacaacagagcttatgttgcacatgttattttattcttcactctttccacttaatgatatgtctgaaagatcttgagatatcaactgagaacatatatctcctcttcatttttgtatttaaatgtttttattgaataatttagaagagtaaacaaagaatgtccttccttctttctctgtaattcaagataaagccaaaaaccttagagaaaatttgaaggggctgagaatagggctatactgtcacttggtttttgaatagcctgcttcatatttttaacagccacattttatcacatcatatgggcgcacactataatttaattcatcaactaaatattttagttgtccctagtttttttttaatctgttaaaacaatgctgtttgtaatagaaaacactcttacacatttatattggagaactttggcaagggttatcagtaggattaattactagcaatgaggatattttcaatcttgaattataggtatttataatggtgtctttacaccaccaccctctgctccaaagacctgtgagcttcttgaaggtagaacgaattattattaccatcatcatcgctagtgtgtattggtcaggctctatgctaactgtcttacaagtgtttctcatttagttctcataacaaccccttggactttggattattttcatttcacagttgatgtgcagtttatgaggctgcatttgaacttcctcctaactgctgtgacctcttgcactcggctggccttctggagatatttattgagtgattatgtctggaacagaacaaaacttgcacagaaaacaaaacaatcattgttcatatttttaaaaaggcttttctttcttcatccacaaattgtctttgcaattctgttggttattttgcttgaggacatttatcttctggaagaaatcactggggaaaaaatcagttttatgtttaataccaatggttccactaatatgcccctgaattaacagttatgtgcaagtttttaatacattctcaccatatttctttgatagagaaaaaaacagggagaaaaggagttgtgtaggggcttttcataattttttaaaaaagtttaaataaatcatttatttttcaaatatgtattgagcatgtattgtatgacaggtgctgtgcttccagctggaggaacaagataagagtagaaacaccttaattagccaagcatggtgactattagccaagcatggtggtgtgaacctgtagtctcatctacttgggaagttaaggtgggaggatcgcttgagcccaagaggttgaggctgcagtgagctgtgatcacagcactgcagttctgcctgagcaacagagttagagcctgtctcataaaataaaataataaaggcctaaataaacatgcaggtgtatagggtgattgtgagtactctgcaaggatgatactggagagtcaggaaagtcacatgaaagctgcaatgtgatgttcaagaagagcagaagtctggtgtgagccggagcctggcatatctcaggagccagaggaaggagcatgagggtgagaagcagaaagcatgagaagagtgattcgaggagcagctgctatttggccctggtggtaaatgatctttttaacataatatctttattcagatgtaattcacatgctatacagttcatccatttaaagtgtataattcatcggtttttagtatattcagagttgtacaaccatcatctttatcaattacaatattttcatcacccccaaaagaaacccagtatctgtcactttcattttcccctactcatgcccccatcttctcaaaaccacaaatctactttctgtctctacagatttgcctattttgaacatttcatataaatagtatcatacaatacatgacttttgtgtctggcttatttctcttagcataatgtttccaaggtcctccatctatcaaatcttcactcctttttattgctgaatacttactgaattttattgccaaatacattttggtaatattttatgtttgttgttatattgtgatttcataagcttctaaaaatacctcacagactttaagtactgaaacgagctcacctttaaaacagtagaaatgtgaaattaagtcctgattattaattgttattcttaaaacatttaaatatcatgctatggaattattataaatgttcaaatgtgacttctaaaatagaataacatgtagtttcttttttgaagaaattatttcagcattttgcaatgcttaatttttgcaacattatcagagcatgaaaacataacacattttataacttcaattatagaagaaacgagttgacatagatttgttctactttcccaataatggatataaattggttttagtgatggtatgtagggaatatttttgtggcaaatatttgtacctgtttttatagaaaggaatatgtgaggcaagttactttctattaaatatttttaattgtttt

SEQ ID NO: 3156 - DNA, 4477 bp, Homo sapiens
gttttatcccatgcggtttctccatagtgagtgtgttctcatgagatatgacagtttaaaagtgtgtggcagttcccccatcttgctctctctcccgtcaccagttatacacaagatgaatggattaaccactggaagacctgcactactacaaatgttaaagaaagtccttccaagaaagaaaaaaggcaacttaatggaaacttgtgtctaccaaatggaaagaagagcaatgggaatcctaactacggtacactgaagaacacttttgcagctgactaacaactcttgatattgagaaagttatcagaattatttgcaaatctcctctcagatttgcaaaggatgctggcatttctccatgaggcaggagtgtgagaaaaaaagttgaatgtggtgatggggaaaacactgaagttcaaaagaagcgaagacaagaagctactcatggcagcagcttttcccataaatcaagaaatgctacagattataaatgagatgagactatcaagaagagacctaataggagtgtgaagaccaaaaatttaaaagacgtggttatatactttgagtaaactctatatataggacaatgttattgtttggttctgtgttcctcactcaaatctcacctcaaattataatccccatgtgtcaagggcaggaccaggtggaagtaactggatcatgggggaagttttcctcatgcttttctcatagtaagtgagttctcataagatctgatttttttataagcatatggcatttcccctcctagcattttgcctcctgctgccttgcaaagacggcagttgcttcccctttgccttccgccatgactgtaagttccctgagtcctctccagccatgtggaactgtgggttaattaaatctctttccttataaattacccagtcttgggcagttctttatagcagtgtgaaactggactaaaatagaaaattggtaccaggagagtgaggcactgctgtaaagacatcactataaaggcacctgaaaatggaagcaactttggaactagctaatgggcagaggttggaaccatttgcagggttcagaagaagacatgaagatgtgggaaagtttggaaattcctggagacttgttgaatgctttgacgaaaatgctgatactgatatggacaataaatttcaggctgagatgctctcagatacaaataaagaacttgttgggaactggaataaaggtgactatttgctatatatgctttagcaaagagactggtggcattttgcctctgtcctagagatctgtggagctttgaacatgagaaagatgatttagaatatctggtggaagaaatttatatgcagcaaagtgttcaagaagtgactcgggtgctcttaaaaccattcagttgtatgcattcacaaagatatggtttggaattggaacttatgtttaaaagggaagcagagaataagagttcagaaaatttgcagcctgatgatgcaatagaaaagaaaaatctcattttctggggagaaattcaagcctgctgcagaaatttgcgtaagtaacaaggagacaaatgttagtcaccaagacaatggagaatatggcctcagtcaatgtcggatgtcttcactgcaagccctccaatcacaggcctgaaggattggagagaaaaaataattttgtgggcaaggcccagggacttgctgctttgtgcagtctctgaacttggtgccctgcatcccagctgtgtctaatagtggccaacatacagctcaggccattgctttagagggtgaaagccccaagccatggtgtcttacatgtggttttgggcctgcagatgcacagatgtcaagaattgaggtttgagaacctccacctagatttcagaggatgtatggaaactcttggatgtccaggcagaagagtactacaggggcagagctctccatggagaacatctgctagggcagtgcagagtccccactggggcgctgactagtggagctgtgagaagaaggccaccaacctccagaccccagaatggtagatccaccaacatcttgcatcgtacacctagaaaagtcacagacgctcaacaacacctcatgaaagtagccaggagaggcgctgtatcctgcaaagccacagaggcagagctgcccaaggctgtggtatcccacctcctacatcagtgtgattggatgtgagacatgtagtcaaatgaggtcattttggaacttttaagacttaatgactgctttattgtattttggacttgcatgaggcttgtagcccctttgttttagccagtttatctcatttggaatgggactatttatccaaagcctgtaccccattgtatctaggaagtaactgacttgctttggattttacaagctcataggcagaagggacttcccttgtctcagatgagactttggactgtggccttttgagttaatgttaaaatgagttaagactttgaggaactgttggggaggcatgattagttttgaaatgtaaaaagacatgagatttgggaggggccaaggacagaataatacggtttggctctgtgtccccttccaaatttcacctttaattgtaatcgccataacccccacatgtcaatggtggaaacaggtagaggtaattggatcgtggaggcagtttcttctatgctgttattcatgatagcgaatgagttttcatgagatctgatggttttataagcatctggcatttcttctgcttgcacttctcattcctgccaccttgtgaagaaggtgcttttcttcccatttgcgttcaaccattattataagtttccagaggcaaacccagccacacagaagtgtgagtcaattaaacctcttttttaataaattaccactctcaaacagttctttatggcagtatgaagacagactaacacagaaagatatagctgttttggaaacatcagaagtacagttgtagcaataaataaaatatgaatagattaactttcgtacacctatttgtgttgaaagcaccaggagtcatagccaacaatcactttaatatttctccagctaattcttctgatttatttttatgtttggttagccagtgacttccccactagctaaaaaatatttttaaaagtatgtatgtgttaatatatcttgactactttttaattttccaattaaaaaataaatcacactttaatctctgtgtcttgatttttctcatttaagaagagctcattgacttaggggctacatactatatgacaagttacataaatcacaattttcttaaatatttccctattgatggttactcagttttattttttttatttttgccattagtaacagtgaagaaattaatgatcttgcatttaaattttaagtacaggtgattggcttctttttacaacattaaagagttgtaattgacatacaataaactgtaattatatagtaggcagcttgctaagtattgacatatgtatttacacatcaaaacattaccactattaagatagtcaaacatccattatctctaaaagttttcacatgttactctgtaattattcctgtctgaccctcccactgtccaaaggtaatcaataacctgctttctgtccctaaaactcagtttgctatttctagaattttctataaccaggataaattttttaaagatcttatttttttcactcaatagttattttgggtgcatacatattttttaggatatcaatagtttgtttttattgctaaggtattattttatttatgaatatcccacaatttatttatttatccaaatgttgatggacatttggttgttttgagtttgaaactattataaataaagctgctataatcattggttttctattctttgtataacatatattgttgtggttgaggggtgcagatatctagaaatgaaatagctcgattgatggtaagtatatatttaatattttaaggttctgttaaactgttttccaaagtatttgcgttatttttcattcccactaacagtgcctgaggattccagtttttctacgtgcttacaaacactcgatgtggtcagtgtttttaagtttagcctctctgataggagagtggctttaatttgcatttcactcttaactattgatgtcaagcagatttctgtgtgccgatttgccatctgtatgtctttggagaagtgtctgttaactattttaccatttaataaaaactatgttgctttcttattactaagatttggcagttatttatatattctggatccaagatctttatgagatatatgatatacaaatatgttctccaaggctatgatttgccttttatttacgtaatagtgccttgtgaatatcagaagtcacttttgatgaagtctagtttaccaattttgtacactctgagaatttcaatgttttgctttcattttgcttcaatcctag

SEQ ID NO: 3157 - DNA, 9977 bp, Homo sapiens
tctagaaagcagccacggccaagagtccagaggttccaaccaggaaataccatgtcagggaagtgatgccacggatctttctatgaggacaggaacgtgacccattgtcaccccatggcagcctccatgggctgaggcactgagtgtcccacagtgggcccggctccaggttagatgagccatgactaggagcaaggcgccccctagaggggccacacaacagaggagctactggagtgaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgccctcaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagacagagtgagactccatctcgaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaaaccccatctgtacttaaaatacaaaaaaattagctgggcgtggtggtgcacacctgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaaggcactttggagggagaagactttcagagttaggcagaccaactaagaggtcagctgaagcacctaaccagttgtaaggaggtgaaagacagcaccccaagaagagacgtgcaggaaggaggaaagaggcttggtcataaaggatggaggaattccaaagtgacactgaacaggctgcgtttatcctaaaataaaaccactcctcactctgtggatgcgttgaagactcattcccaaacatctttattctctaacttgccctcttcctcttcctaatatgctcactcaagtaaaattactagtgtcctaatgcccctatgcatattgtcaaaaataaaaatcagaagcaggttagatctgttaggtcttccagaagagcaaacctgggatgaagccagagcccaggaattctgaaggtagcctttggactcaggacaccctactcttgtctctcctctcagtttctctgctatgaatctcctgattcatgaacacgttatctgttcacccttctctctaggtcttagttcttagattttccttctgtaaaatgcatgtgatcttattttcccctccacaactttccagatgaactagactgtgaccaagaggtctataaaatcaaagcatcatggaacaggatcttgtatcagaccaaagtgtgccagtttttaaaaatgtgcatcaaaatggaagtctcagagacagagccctctggtggaaagttctagtaggttaggacagtcctgcctgcagacaccttgggctttactgagggactcaactgagaaaatgaggaatgttgcagctcatgattcttagaagaagaaagtgaagcttgtttaaaatatgatttaaaaaatctgtagaacactgtaaactacacaggctatgagggaatagcctggttgggccagcttggaaatcgggcacaggcaggaaggggcctgtctggtttgggccgtgtccacagagagcacttcttaggtcctgcctggagagaaggaatggctgggctatattttcttccagactcattatttttcttctgtttgacttttctctgaatttcccttgatttgtataaattttctcaataattagtgacagtgtctactgattgtaaaatgaagcttgaaggccaggcgcagtggctcatgcctgtaatcctagaattttgggaggccaaggtgggtggatcacaaggagttcgagaccagcctggccaaggttgtgaaaccgcgtctctactaaaaatacaaaaaaattagccgggcatggtggcacgtgcctgtagtcccagctactcaggaagctgaggcaacagaatcacttgaacctgggaggtggaggttgcagtgagccgagatcacgccactgcactccagcctgggcgagagagtgagactccgtctcaaaaaaaaaaaaaaaaaaaaaagtttgaagaacaaagacaataagaggaaatataatgagtggtcataaatgtgggctctgacagtagagtgcctgggtctgcatcctggtttcttagtcatgtgaccttaggcaagttactttaacctcgctgtacctcaggttgtccatctgtaaaatggggataataatagtgcctaccttttaaggttgatgtggggattaaatgaggtgttgctcatacaggaatgtgcctgtgcatggcaaagttcgggaaattttttataagctgttctaggcctgaaatcttcagaagatgctaatctaaattcatgaaataagcttcttacaacagaaatgctgctagtattatgcaaaattaatgttgtatatcaaacttttaactctcatccctccttattcagatatattttgttataagcaatgtttgttcccctcgttattataccacagtctacttacctgatgctatatctgcctccccagttagactgagagaacaggggatatacctaaataataataataataataataataataaataataatggagagctccttgaagatagggagcctgtaagaatcattgagggcttattttgtataccaactgctaaactagatgcttcatacattgttgtcaatactcatgacagccttgtaaagtagaaattaattcttccagttaacactaaggctgacatatgaataccttggcaaatctggaaagctgggaagacagtatttgaattcaagacttcttgtcaccaagggccatgcacttgtactctgccatgtggcccttttttacctcctgtggattctccctacctggtacttggccttaggtgtacacacacctggcactttgcttgacacataataggtggaccacaaatatctactaaatgaatatttgcatatagtaatattttaaggtactaaaagcagctcaaagtaaatatattaatatattaattccattgctatctggataaccactcaactttcctgctgaaaatgcccatttaattaaagaaggttggatagagctctctatatgcattttggacaggcaggggtttcaggtcataaacattctgatgagttaatataaaataagagaaactgtaaatttccactactaaaaatcacaaaaataacagaaacaaaagaagagataagaatttggggaattgtgctgaacaatttagtggttaaaaaaaacaactgtgcatgtttagacttaaataagcccccatccaagtgtgaggggtccagtaatttttcaaaacatatgaaagtgttaatacatttcgacaaaggaccattaaaaaagtcctgaattctgacttgagggaggaaagtaatgactaatacattctctagagacttgcagactttgggaattcataaaggaatggatgataattattaactgttgctggctgattgcccagacagttctcaacagccctgtacaagtctctgggtttgggatggatcaattctgagactggaaaatggccaaatctttgcaaatgagaaatatttttcttataagttcttattgtaggcaaataattacatagattattcatcagagaatttttaaatgctcataatctcaactctttcatttacaacttgtatttccaatagtttatgggtcatctctgcatagatgtcagaagtcacctcaagtttagcgtgtccaaaatctaactcacaggtctgtttctgacctcccaacttgctttccttgtgtttttcctatgctaatgatccaccataatcaaaataattaacatttatccagtgcctactatgtactattccctgtcctgttttacatttactcatttaaagtccataagaaacattaaatctcatctgccttctgaagaagatacaaccatgctctcttttacaaagtaggaaactgggtcacagaaaggtgaagtctttaaggctgaatcacagtagctcatcctagtaaatagaaaagccaggattcaactccaggggctgggtgcagaactgctattcttcactgcttcaccaatcagcagctacccaaggcagaaaactttttcatccttggctccttcattctccctgtcaccccagatcccctctacatctagtcagagaataggtcctgtcaattccaacttctctatatggctcctctcaggcatgtgcccttaattggcctaattctctaatacaccttccctctacatgctcactccctcagatcattgctttatcacgtgttacctgggttgctattacataaagagcaatctttctaaaatgaggatcttatcacttcacttccacactaaaatgtttttcctggggaaccacactccttagcaatctgacccatcagaccttccaggctgtctcctgcctgctccctaaggctccagccacacagaattatcatgggcccacacacccaccaaatcctcccatgcctttgcccatgttgtctgggatgcccttctctcccttctgtctacatcaagcatcagactgaatatccctcttgtgcggccttctaaaacctcccgtccaaagcgaaatatattgccctctatttatacttttacagcatttggcacacaagtacagagtagtagctttttatcacattctctgataattatatagatatggtatttcttagctctctctccaactggctaataagttgctttttgtctgagtgcctaattttgtgttttgtgtctgagtgcctcagttcctcaaaaaaaggttttttgattagttcattattcatttgaacatggaaattatgctcactagtggcaaatgccactaaccgtattccagaagctaggtgtcatgtttgcaataagatatattatcccttctacaagtcaccttttatttcaggcatttgtaaatgcccattaataaagtatggttcataaattttaccttgtaagtgcctaagaaatgagactacaagctccatttcagcaggacacaataaatattattttataatgcatctattttgtgttttactttgttttggtttttgagagcaacaaaaatgaagtaaacagatgaaacagcaaaggagacagtccacatgataaaagccctgtgctgtctgaaaacccaggccctgagtggacacaagagaccaagggattgagggtataagacagacaaagaaaaaaagaaaagctgatgtagagagatgattgggaccttgagaggagactgagaagctagagacaggaaggacaaatgccagaaacagaaaaaacccggagggcagcagaggtgcttggttaaggtggagaagagagttctgccttggtcaacctagagagaggaaattgaggacttaaatcacgttttgggggtcatctccctccagggaagaagctttgtcttattcatttttcactcacagtgccctatcacaggagccaatgcctagcagagcttagtaagtatttgttgaactgaatttggattggcacccacatatcagaagaggaaagagagtcctggaaaccacattcagagtccgagtcccaaattggagagtagaaattctctgtgtcacccatagtgccacttggaggaaagggataaaaagactgggcttttaactgaggagaatgaggttgtggtttccacagaactgtaggtgcagggcctctgaatgtttggtaaacactgaaggggaggtgacttactaacaggcgctgtgagatagcaaatggtttttaggcctgagacaaaaccacttcctctattccctgcttatcagaggccacagctgctctgttctgagccagcgtttgcagataagcctggtcttccagctccccacctacatcttcttgtggggttgaaattgactgctacccatgtagaatttcggagtccctgtgtagaaactctgtaggcagatacagcaaccgtttgagaagataaatttcgctagtgtttctccagtgctttctgaggtttggcacatttcatttcatttcatctacacattagccataggactttcagcttgaaattacctccacctccttaccctcactacctccaatacacagcttcactcattcacacaatgcccattcattcttctgggataagctcaagcgtcccttcctggggggaagttttccctgttcctccaggccatatctgatgcccgtgttttgcgctcatagtacaacacctcttgcctttacagcagttttcaattttgtctttaaatatttctccctgtgattattttattaattcctctcttccgtcactggactgtgagttccatcaggacacagatcatgcgtggttttgtcaccatttgtatccacagtgcctgacccagtgcaagtagtcctcaatttgtaatactttaattattgaagacgcaatagcttatcagcctttaactgtgttagctggcatgttacaatcctttggcatatgtatcaacgacaaagccaggtatactgtttatttctgaagtatattaccttcatagattctataaaacccttggttggaaatgcactagaaaatattgattttacctgctatgcaggagacacagaagagttaacacagcagggctaaaactgctgtcctttgaagggcatgcttataaggttggcccttggctggtgtctgagaacttggactttgggacggttcctaccattccctgataagaattccctgataaggtacttacactgtacctaaattgttggcacaacaatttgttttttgctgaatatctgctttctttcttggattctggaattttggtgcatgctaggtagagggtgcctacgttactgcctgcagagaaaaaccctaaatgcctaggctccatcgagcttctttggtagattacatttcaaacatgacacaacatgttgttgaaggaattacatacatcctgtttgactccactatgagaggactctagaagcttgcacctggtttcctctggactttgcccttttgcctttgctgattttctttgtgtttattcactgtaataaatcggccatgactatggctatatgctgagtcttgtgagtcctcctactgaatgactgaatctgggggtggtcttgaaaaccccaacacaactcctgaatgtcactacaatctatctacctctctttcaccactaactacagtagtccaggttgccatcatctcttacccagacaatagcacttgacctcttgcagtcgtgcctgctcccagtccaatccattctctacaccacaaccagagtgatctttccaaaacacaaataatggttatattggccatgctaatgtcatctggtggcagaaaggaccaatggattgctgtggtataaggctttgtatatgtaataacttataagttgaaaatttataattaagccctggcacagtggctcacgcctgtattgggag

SEQ ID NO: 3158 - DNA, 1021 bp, Homo sapiens
catcagttgaaggctatttgacagctttggtttcttagctacagggcttactatgtaagtttctgttgtgcaatagttgaccttgaaagcagccaaatccccagggaagtgacaggtgatccggagagcaaaagagggtagcaagcaggagacatgaggagcaggcagcaaaaagctgtcaggaatgaaagggtcatcagaagatccataagttgcagaaatttgagcagttggaaactaaattgatattgatgatttgaaaacattatcagaagaaagtatgaaaaatgaaataaaaagtagaaattaaggaaataaggataacaaaaggaacacttcagagacccaactcgaatgtttggacttagaaagtattatagcatttaaaataccagtattaagagttattttcagaaatgctctaaggaatgtttctattctatgtgcatccctgtgcccttgtgttaggggttgaattgtgtctacctctccaagaaaaaaaataaattgaagtcctaacatccagtacctgtgaatgtgacctcatttagaaatgagtctttgcagatgtaatcaagtaaagaagaggtcattaagtggactctaatccaatatgactgatatccttctaggaagaggaaaaatgccatgtgaagatggaaatataccataggatgacagaggaagagattggaatgatgcagttgcaagccaaggcatagcaagatttgatgtttatcactggaggctgggaagaagcaaggagagattctacccagagtctcagagcaaccatggccatgatgacaacttgattttggatttttggcctccagaactatgagagaataaatttcttgtgttttaagctattcagtttgtgatacttagtaggggcatccctaggaaactaatacaatttatttatctctttcttatatcatcacatcacttaaccagcaaacttttattaaacatctactctgcataggtaattctgccccttcatttcacagctttg

SEQ ID NO: 3159 - DNA, 3071 bp, Homo sapiens
agaggttgtcaaaagttctgtgcaacctttgatcctctcatttttgttcattctggagcaagcaaaatctcattgccccaaagtggcaccacacactgagctaatttgcctttttttaatccttccccaaatcacagccagttatgcctccataatgtgctagctctcccattcaatccagtagatggctttttatttttttctcaagatttttaaattgtgaatgggaggcttggtctgagttatctattatttctttattagactcagaggtccaaaaatgcttagaagatgctcaataaatactgattagatgaaagactagaataagtgtgtaagttctgaatggaaataaacatgtgagtatgtggatataattatagcagagagaataacagatatattcagcaggacctgggggactctagcatttgcacccacttggctacatttgttaattatgtctaatccccaatgaccctaaacaaaaagatttaaaaggctgctgaaaaccgtgttttgtgcaatgcacagaatgttatatgaaaacacgggatcccaaaaagggaattcaaaaacatgcaaacactacagccaatgggaaagattgcatagaaataaataaaaatacattgaaagcaataaatacacagtgagtgcctacgcttctctgtttcttcttgcaagtcacactgcaagttctcatacttttttttcttctcagatatttaagtaaatttccgatattccttaactatctgcctttctgtaaatttcttacctatctgtaaaaccttacagaaattacagaattgggaaaattttttctgaaagttttatccttaatccttgaaagcataatccagtttagagttcccagtttcctgagcattggttactatggtctactccccacatcccgaaatgatgttgcactatcttctttctccttttacatgtttggccaatttaatcttaatattttgaatttgatgcttttctcttttctacctattcttcctaggttatgattttattcatattcacaaataaaaatattgcatctgtaataataatttgagacgaagccattactctaatcctgattttttgcctgcgccacagacacaaattccagatgacctgtaggacaaagcccatgtagattttcaatgagcttttcatctcaacatgttcaaaactgtactctttatctacttattgccactatctactcccacacctattttcttcctatgatgcctgctttatcaatgtcacaaaatactctattgtaaatagtcctggaaactccaagacatcattaatgtgaatgtaggaaagagatgataatttaagttagaaaaggttggtcagagaagctgccatatggtagaatataggcgaagtaaaacaggtgtagaacaaacatgagccaatttaaaatatttcttctccagggaacttaatgtttccttgagaatttatgcctgtggacagttctattactactactcaagctaccaactattatggcagatgatgaagatcatacacactttgtgaggtgctgctctgagtgatgtatatgcacttattcaattaattcttacatgaggaaactgagactcaaagacatagaataatttgcagaagtttacaagttgagacttaggactaaataacttcatatggaaagttttgtttttaagaaaaggaagaagcagatcgcaattctacaggtacattgttatttaacttcaagaagaaaagctatctagaaacagccttaaattataacaaattgttctcatctcactttgcctcctggtctcattagaactagtattggaaatcttgtcctgtggttctatggccagcttcccttaccctactgagaaggtaagtacttaccagacactacaactgacaccagctctcagatttcccctgctgccctgctatattcaacaaaaaatataatagaataaaagctaagcaaccaaccctaactcttacaccgagttaacctgtctctgtgtaacctgtttgagtatttacatatacaggtttatttacatttacatatacaggtatatgaaaataggattttaattcaaattcctaaaattaaaaaagattgatagagcatgagcaaattatgagtttgaaaaatccccaatcattttcagcaacaattttcatgtttacatatgcccctgtattctctactttatgaattataaactccttttgcatactttctctctgcaggaaaatggatgcaagttttaaatatagatttatgacttttatggaaaataataattaggtagttctgtagccttgggcaaatactgtaatttccctgcacttcatttccttatctttaaaataaaggtatcagaagagattatcttaaaatgtccctccaagttctaccattctgtgatacactataaaataaactaactaactgccatttagggatgtctccaataacgtgacatatatgagttccatttacagatgactatgccctttattgaccttgacatagcctctccagagttacacattatagtaagagatgtatatgcatttagctccatttaacattatggcatcagggaaatgaagaattggagctggaatccaattcttgatattttataatcactgcttctaaaaatctatacctagcaataaaaatgtaataaatacctttttttttgtgccacccggttaaaagttagttccaaggatgttacaatgaagctgtctgtacaaataaatctgaaaatgaaactaaaaagatcataaagaaagtgtctgtttgtatttccaagggtgaatcggcctggaagctgttcattctctcccaagcctgaaacagcggataaacgaccccacctcatgctgggaagagagagcttgggatccctggcacgtgagaaccagagcctggtgtagatcagagctctccatccagagtgtcatgacttagctgcatgctttcaccagcagggaggagggaactgatactggagtgattcataaccttctaaaac

SEQ ID NO: 3160 - DNA, 4931 bp, Homo sapiens
ggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatc

SEQ ID NO: 3161 - DNA, 232 bp, Homo sapiens
tctctttcctcccatgttaaaatcggtagcatgtccaagcctctgggcctactgccttcggttagctcacacttgctttttcatgtgaagtttgttctatggcataatcttagtaaagcgttttaaaaacaaaaagatacggaggctttttacaaccccttcgcctaattatatgattcattaaaagaatcttgggggtgggcatgagtcaccacgcttggcttaatcacag

SEQ ID NO: 3162 - DNA, 3141 bp, Homo sapiens
agataatagacataggaacctaacagctcccagaagccagactgagaaagaaaagcataaaggacacgcaacagcatgatgcctgaggtagaagtatgatagttgaactttattgtgctctagaaaaagcaataaacccttctgcaaacttcataagatagcacagtaaaaggaactctacaccaagaggacattttcccttcaaaataacaaagcagaacacaaagtaaatcaaagcatataaacggagaaaggaattccgttgcctttgaaattgaactccagaaataatttacttaaaaagagttcctcagatatagcttgaagtctaaagacaatcattgatcatcaactggtattctcttactccatcagcactccagatacaaagcaagagaaaacccagagtaaaaaatttaaatggacaatatttcatctgcaacctggaaagtcttctatgcttgctgttgtattgactttcctacttatctcagaaaattgtgcatttaatcatctctctctattttctttgactcttttccagtgagagagtataagattgtttacctaaagacctcgaagtctagcaagataggaagcaagttgttacttaagcaggttgggggggcattatgggcacaatgaaaattaatcattggttctctttgcctatcaaaatacatcgttcacataggacccctttccccaataaatttagatcatgcctactctagaaaaggaatcacagcattgtcacttcttgatgttgtgaagtaatttgtaatgcgcagaaatgatttgaatacatgtcccaacagagctttgtgaaggaaactcaaagctattctgacataatagcaaatgatagcagagaagggactgaagcactgcagcaaacccaaaattgttccaatattcagctgctagaacaaaaaagaaaagcctcactactgaacctttttcatttcgtatagctgctcaaaatttagaaaactcatagaccataatccattaaaacagcatctattacatcaagttctaattgctaaacttgctggtaaatccttggggtaaagagattggaactcttccattttcaataaagattatttgtaaaactaaaaaaaaatccatgagacaatctgatagatgtctcattattcctgatctgtgttcttttttatttcttagccctacctctacaaccgattaaaatgcttagcctaaatactttcaccatttcaaagaaaccactacaaaaagtgctattttttggccgggcgtggtggctcacgcctgtaatcccagcactttgggaggccaggcgggcggatcacgagatcaggagatcgagaccatcctagctaacacggtgaaaccctgtttctactaaaaaaatacaaaaacataattagccgggcgtggtggcaggtgcctgtagtcccagctactcgggaggctgaggcaggagaatggcgtgaacccggaaggcggagcctgcagtgagccgagcacgccactgcactccagcctgggcgacagagcgagactgtctcaaaaaaaaaaaaaaaaaaaaaaatgctgtttttttcctggattttatgaggataaaatttagataatcttttaaaaatatgtacaatataccaaactatttaaatagacattagcattttctgttaaagtactgacatagtatttgcaactattttttaaatcatttttctactcttgatcgtttatagtcagaatttcagtcaagtttagcactatccaaaaaaatcagacaggatgtgttgcttcacaaataagaagctacatgtaagtcctgaagcacaaggtttaaggaaaggatttcagcaatgacttattcagcagatactcatcatatttcctcttgtgagttctgttatatagtccatattcctatgcttagagcagggattattctgcctcattggccttaaactacatcagccctataacctctacttccccacaggtttcagtgatctcccaattctgtcgcagaaagcttttccaacaaagtacacatttatattacaaccacaccccatatgtcctccatgaactcttattaattctccaatacacatgccattttattgctctgtgaagtcttccatgttttttccacgcatgctttctctgctggcctctgtgtatacctctattatatcatatagttctgtgcttatcacgaatttttgataatgcatttctggcaataaaggagaataaaacagaccctccaaagagtttggatgaattagagcaaggtggcttaccatcagcataaaatttcttccttaaagattagtttaattttattttagatataggggtacatgtgcaggtttgttatatggaaatattgcatgatgctgaggtttggaatatagatcccaccaccaggtagtgagatgctaccaggtagtgatacagatgctcccaccaagtagtgagcacagtacgggttaagtagtttttcaacccatgtttccctccgccattcctcctctactagtctgcagtgtctattgttcccatgtttatatgcatgtgtgttcaatgtttagttcccacttataagtgagaacgtgtagtatttgcctttctgttcctgccttaattcacttaggaaaatgacctccaactgcatccatgttgctgcaaaggacatgatttcttgaaatcatatgttttatccggtaaaaataccttaaaatatttcatgctatgccattatgtgtccttttaaattatttgtcattaataaaattgaagtttaaaattatttctaatgttcagcctttgttttgtgttctctttgcattagcactgtacacattcagtttaagaatcacctttttagattcccaacaaatggaaaagtgatatttgtataatatatatattttgtaaaacacaaaacaatatgcagcagaaaaattattgcactaagcacatgtattagaaaagaagattctcaagtaaatgacatcagcttctacatttttttcattatactttaagttctgggatacatgtgcagaatgtgcacgtttgttacataggcgtacacatatcatggtggtttgctgtacccatcaacctgtc

SEQ ID NO: 3163 - DNA, 3943 bp, Homo sapiens
cctaattgatcacatttgagaagtctatattttaataatttgcagtttcataatacatttatatatttcaaaaatataaccaacatattagttagaaatattatatttgttactattgatatgatttgacaatcaaaactttactgggttaaataatatttacttagctaagaactcacaaagatgaatgacgggaaacaacctttacctggaatttactgcttttggtattcaaataagatatgtttcaagtattaactgtggtcttctcttccctcgcaggcttggaaaagcaccagataggaagggaagaagctcaggatctgggtttaggttctaactctgaacttaccatctatatgatgtcagctaagtagaccattttgtgattctgagcttcagtttttctcatccactaaatggggaaaaaaaactgctttacagagttctaaggattaaatgggacatcttctatgaaaatgcctggtacaagggaggccctcaagaaggtctgtcatcccttacactgaatcaggactggcgtagtgtgacctgtggaatacagtagaagtaaagatgtgtgactcccaaagcttggtcatataaggcattgcagcttcagccttgctctcttggatcacttaccctggagaaagtcatctcccatgctctgaggatactcaagcaactctgtggagtgttccacatggagaggaagtgccgaagacccgcaccaactggccaaaaaagtgagtgggtgaccttggaagcagatcttccagccctactaaagccttcggttaactgcaacctcaagagagaccctgagcctggatggctcaactgatcagcttctgaattcctgatttacagaagctatgagaaataaaaagtgattactattgttttaagctacaaaatttggggataatttgttacatagctatactaactggaacacagagatttcttcaaattttcaaaaatttttttactctcagtgatgttcattgtcttggaatgagaatgggaaacatagaggtgggagatagaaatttaatggcttagccagccaaatgaaccacatcaactctgcccattggtggggagacagatatttcagtcatattgtccatcatatatccctactttttgtggccttgcaaaataactaataaccgtaaagctgtatcatcacaatgcaataataataggttatttcagtaaaaagtatgtcaaattaaatgttagaagtatgtcaacacaagtggctgattgaatgaattttttactttagaactgattatttggccaaaacgtagaaggttcttgggatcaaattttaaagctaaaaatactaaactacattttttagtctggggaagggatcccagatttataattttatttgggttttcctaagtatagtttaaaacaagttttgctgcctttaatggaacatgaaattatggatcaggtgacaggaacacagtatgttccttttggattataaactggaacttcagatgtcttccttgaagattttgaaaaactgatctattatatatgtacataaatacctggcctttggccttcctatgaagtgatctgcaagttcataaagtattgttctgtttccaggcttcagggtattaaaaatgtatatgttcatttgtttgaaattatctgaagctctgggcttccccatgctcacccttgactctttcctttttgatatgttctgcatatcttggtgtatttatgaacgactttttagatgtaagtttgaaggaggagattctttaatctctgtagttttcatcaacagagtgccattttcccgggaattactatttttccctatggccttgaacatggcttgttattgagtggtctagtctcctgacctgttaggccatagaattagaaaaacccttgtttccactttcatattccttatatataacatcttaatgaaaccattgtggtttatttgcacagaagctcccttgacttctcttgggaacctgctctaatactttgtggctcttgttcatgagaacattctttttcctaatatctgctctaaatgttaccttccttagctgaaggctttctgtcccccattttttgaaactacaagtgattccctttcctcactgaagactaaactttatacctaatggctagaatgtcaaacaaacattaatcttgtctcctgcctcttttcagatggaggaatgcccaaaagcaatttagctttagacagcagatgtatttgtgtagtgttctttaacctctgattcattttctcaaatcattttgggttaagcttcacttctcaaagattccaacagcctaaggatctaccttgaaatttcataatcattccatacacctacctttcgttttaaattatgtctctcccttacataagctacctactgtaaaaaggatacttatacatttgcaaaagaccatttatttgccacaacaatacatgtatcaggtttgaaattttctcttcgtagatagggcctactctaagaccacttaatacgcaaaaaattcatactttccaaagagctatgtaaggggcaattgttcacatccaggcaaacctccccactttcctccactccaaacacatacacatgggccagtcacacggaaattccacctttaggaatgtagcccttagggataagtagttcaagattttaatgtagatcttctgggaggacactggaaattcttgatactcttgcttcacacttttattaccaaactaagtggggtggggggtggaatttcaatatgaagacctgaaattagaataagctagtactttgagccagcaattatttattctttttaatatgaattagtgtgatctcttctttattgttaagatagttcattgaaatattatttttgagctagtgaggatttcaatgaaaagatgataattggtcttcttctgggaagagggcggtgatgactagcacaagacaattttcaagtgaatgggaaggctgaccagtgaaagacactttaacaaggggttggggagtgttagaaggcagaagaattgtatagaagagcatctgccctccatcccaacttaaatctgttgcactctcttttattcatgcactagaaaaattcttaaagctatgttgaagttactgagttgcttgtctgttacccccagtcaactctttgaggatagaaagaaggatgctgtgctgtggggggggaatatgaatgagataacaggagcatagaggtctggaggaataaaaatataaataatttcatactaccagctacagaaagtaaagccaaatgacattagaatgaaataccccaatatctaagaagattttcaatgatgctgaaggtagcgtgtcaaaatatggagtacactacacgaagttttaagctcattgaaatggagtgaaaagggttgagaaacatcgctccagatgctgggatgcaaacctcatggaagtggaaaaaaaaggagttagatggtccagagaagaccaagtaagttcaaatggtctgttgaaagaaatgataacaatgacaatgattatgatgatgatcaattttttaaatatactttaagttctgggatacatgtgctgaacgtgtaggtttgttacatagatatacacgtgacatgatggtttgctgtacccatcaacccgtcatctacattaggtatttttcctaatgctatccctccactagcaccccccgacccctgtcaggcccctgtgtgtgatgttcccctccctgtctccctgtgttctcattgttcagctcccacttatgagtgacaacatgtggtgtttggttttctgttcctgtgttagtttgctgagaataatggtttcaggctaatccatgtccctgcaaaggacatgaactcatc

SEQ ID NO: 3164 - DNA, 8811 bp, Homo sapiens
ctgggaagttcaagacctggaggctacatctggtgagggcctcatgctgtgtcataacatggcagatggcatcacatggaaggagcatgttcaaaagagaacaaacacaagaggcagcctcactttataataacccactttcatggtaactaatccagtgccacaaaaactaactcaatcccacacaaagaaagcaatgcatcctaatgacctaattgcttcttaaatgaaccacctcccaacactgccacattgggaatcaagtgtcaacacaagttttcatggggacaaaccatcttttaaccatggcacttactccctcaagtatctgactttgatccagtcctattttgccattacttctgtcttggtattggcactttagaatcccatccagcttaaatgcatggaatgagtccagggaagagaaataaggaaaggaagtgatgacaaagacatagatgatgagagggaagagacagccatcattggctctgaaacttaagatcttgtcaaaataatgccatttttttcataccagttgtcaaacttccaaagtatgcactttaagaaacaggtatccctcataataacaagtccagtaagctgctagtgttttcatcattgagaaattgaagtcaaaaccatctgttcatgaaagttaaatgaatcttcattatttaatcaagataaggttatctcttcttagtagtacttcctcccttttctctagcacccacattttacgctgtcaggaaagctcatggtactaattactccaagaagctttttcttacccctgcactgatccctctcttcctttactttttctttcctctgaactaagatatctgtgtcacactctcctgtgtcactataaaagatgaattttttctgattaattaatgtggggatggttgccttccaatctagacagaatgcatgccagccaatgaacagaaagcccagagggccatgccttctgctttctttacttcatccagactcctctagctagtaccatatcatgactataatatattactcagtaaatgatgctcaaaataataatacacatgaaggactgctcagattattacatcaaaagcctacagaatgctcagaatgttatcttcctgaattaggataatctcattaagtctggcatgcacagtgctgagtgaacatgaatgacatacttgagagacagctcccaccccatcagattattaagaataccaggttatctcttcaggcaaatgcctgagcttgggcctcaacagaaagccaatagtaaagtgaacgggctctcagaagatgcacatttccttctggcctctactctggctaaaggagctttcgcaaagcaatcggctaaggatattttcaacatttcaaatagcaaagtcagctcatgcatgaagcagtcactatggaattctatgcatgtctccagaatggaggccagatccgatatgacaactgccaggtgaaaatcacagaagcattatattatgcaatttgatttcaagccagaatgttctgcatcctcaggtttccagccagacaaaacatttttatgttaattaaatgagatagtgtgtgtagcacatggcccattatagttccttataaatggtagcttttgctatgatcattatcattactattattattattattatccaatctgcagtctaagccccacacagtttcccacctaatcacagacatcctggctttgtttttaagagaccactttccatcagcaaatggaaaatggtgttgaagttggagttttcacaataggctgacttcccaataggcctaagatgagccctgagtgctagtctctatatcaagcgtcagccattccttctatcctgcagcatgagagcctcatagccaagcaaaaggagcataaattttgaatcacacagtcctgtatctgaatccatttctgctacttattacttgattgccctttgattaattacttaattttattgagcaacagttgtctcatctcttagtatttacattgcagagtttgcagaggatattaaataagaaaacgtatgcaaaataccaattacagcaccagacaatggtaggcattcaactgaaaatagtcattatttttattattacgaatattccctatctgtgtgataaggcttttgtctcagattctgagatattaccatcaggactagaactctgccatgaagcccaacccacttggctgggactgagttctcactggggccccttcccaagaaggaccacctggaaccaggaaacaactacccacttgaccctgagcatcacaataacttagaaattccagccatgtctctcagagctgacaagaccctctttgcttagcccatgccctggtaacagttattttattatctactctgtggcaggttatatgttaaatatctttcatacataatcactaatcttccaagggaatccaagagttggtttggtgaatgttattttacagttgagcaaactaagactcggagaggttaaaatgacttgctcagggtcacagagctggtaaagggcagggtcaagacttcaaatcctgcacacttgtcaccaggtcctattgcttcatatacacagggcctgacactgacagttattcccagcattttcttcctacatggtgatctagtgggatccaataaaataacctgattcttcagacagatccttctatgtccctctagcagcattatattgccccttcatgatgttacaaaccttcagtgttttttatatatacacatacatatatatatattattattatattttaagttctgggatacatgcgcagaacgtgcagatttgttacataggtatacacgtgtcatggtggtttgctgcacccatcaacccgtcatctacattaggtatttctcctaatgctgtccctcccctagccccccaccctccgacaggccccagtgtgtgatgttcccctccctgtgtccatgtgttctcattgttcagcacccacttatgagtgagaacatgcagtgtctggttttctgttcctgtgttagtttgttgagcatgatggtttccagctttatccatgttcctgcaaaggacatgaactcttccttttttatggctgcatagtatttcatggtgtacatgtgccacattttctttatctagtctacattgatgggcatcttggttggttctaagtctttgctattgtgaatagtgctgcaataaacattttttttaataaagagacagacactaaacagctttgtgagctatacagtctctcttgcggtcactctactctgccactgtagtgcacagatatagacagtagataaacaaatgatcctggctgtgttccagtaaaacttttttgcaaagccaggcagttggctgaatttgacccatgggctacagtttaccaacccctgatcattatgcttgctactcaaagtgtggtccatgcaccagcagcattagaattacttggaagcttgccggaaatgcagaatcttggatcccgccccaaatctactgaatcagaatcagacttttaacaagattctccagaagagtcatacacacattgaagtgtgagaagctctgctctacatgtctttaattcattgaatgcctcttatagtccaagcattcttacagggacaatacacactactagatctatagtcctcacaacaggataaggtggctgttattatcccattttacagatgaggaaacaaaagctcagagaaattagatgaatcaaggagacaatagatggcattgaaatttaactagaaattaaacaatctgctatgatattcatctcagaaatggtatgactaaggccacacagaatattccataggtactaactctagatgtgaataaatattgttttcacaattataagcacaggtgtttatatgctaaagtattgaaattatcgcatagccacagaaataaatttttattctcaaagataatcctaaaagtagaataccctttgctaaactgttttctttgcaatttctcttcacaagttctcatttactcagctttatccaacatcaaaaactattcaaggagccatgtcattacttgggcaatatttatataaattttatagtctttttctaatgcctcaaaaaagttttgaaaaacgatttgaggtagcttagagacacataaaatgcaagataaatatgatgtaaacaatgatacagatcattttgggttataaaatatgaccaaggatgaagactatatacaaaattcacaccattatggtcttataccttttctgtggtataaaaaggacaagagcttgtatcatctattacatggtgcaaagagcccaggcttagaaaacatttgcttgtcaaggatatcatttaatttccacttgttcaaatataaattgtggataataatatctcacagaggaagtgtgagtatgaaataacaaatatgaaaaaattacactatttcactactaatttaatgatttttaattataataattcctgatataaaatataattataactaatatttattcattacttatgctaagatctctaaatggattatctcactgtcttcacagcaaccccaaattactaaaattatccccatttgcacgtgataaaacaggcctaagagaagttcagtaattgggtcatccaatgtatcaggtagctactattatatacaaaaccacccagaaacacagtagcttaaaacaataattatttatttgttcccaattcttttggtcagcaatttgggctgggctcaactgagatggttcatctctgctccacgtggtgttggctaggcttacttattctgtgggagggctaggacagcagagcctctctctccgttggtccctcatcttcaaggaggctggcctaggtttcttcacttgttgccaaatgggttcccaggaaggagtaagaaagggcaagcctcagtgaataagcactctttaagcctctgcttgagtcacattaccaatgtcccaaacctagggttaatgtggagagagctcaacaagggtatacatacaataggcatgattctttgagagtcactgtagtaataagatatgttacccagaatataaaagtgttccaagtttgaactgaagaactgtaaattcatatcccatgctcttaaccatgacatcacacttgcctccaagaaaaattcccataatgttttctacatgatgtcggtttctcttttaactcttaaactgccaccttatgaaacagcaaagatattcctaatctcatctccaaatgatttctttctgacttacaaaatcccttgagtctcagggtaggcttagcaaagtacaaattgaagacagattatgttttcattccttaagtcatttgtactactagaaagattgaactttacatagctgctctctagggacctagctgataccaaaatgataccaatgcattaaaagacaacagtattacctcattttgtataacactttactattagcacagaactttcaaaatgaatataaaactcattcatctgggctttccctataggcatctggaagcttctgaagctatcttagcatggtgcaaaggagtgttttaagggtgttaaactgatgtgaaagaagtactgtagctgaaacactggtggcaagaagactaatctagagactgtggcacaagtttgaaagagttatggcaatgaaacatacaagacctcacaaaagaagaaaaactagtccttctaaccatctagaggggagggaaaagaaagagtcggggtgttcaagggttactgttctttttaatgtctttagacttggcatttttccgtttacatagcacttttacctcctgatggttagggagaacaggaatgctcatcctcattcagagaagtttcatgtggtacactgggacctgcaggaactcactgcagctagccctgtaaattgtaaatgtccacaatggaggaggagggtcaagattaaaattttaataaaagtagagaacaaatgacatgattagattggaattttagaaacatttctcagtcaacagagggaaagataggttggagaaagcagagataagagggagaacaattgagaggcttttacagtaatctgggtgaaaggctataaaaatctaagtctgaatgacagaggggatgattctaaagtcaaacaacctgggcatgcactcctctttgctacactattatatacttttttttcttttcatcaattttggctagagaatatacttgtgatggtgtaaggaggagattatgaagattggcttgtttgctctgtaaaatctataattatcagtcattctttgtacccagaggattaagaaaggcatccctgtatctgaaagattcatttttttctacatctctttttataaatctcccacagttaaaagaaaggagagacgaaggaaggaagaatgggaagaaggaagaaaggaagggagagaaggagggaggaagggaaaaatttcattttcacgtaaataatggcatccttcttaaagaaaataaaaaagtagcattagatgaagttctattgacataattataatcatacagtgaagtcctaaagagatatattgtgaagataatttttcttgtcacaaaggacgatctatacaaaagaacaaaggaaataattttaataaaacattttgccctgagcaagaaatgtgcttcatgtatcatacatgagaaaggatagttgtttgatataaaatggaactgtgaccttgctataagagtttttattacttgatgccactgaaagtaaattaatggactcccaaaaggtgtaaaattcattctgctttgtggcatttgtttgctgacagacaagtttaagaggaatcttttcatgtgattatttaaacaaagagcttctaggaattctgatcaacctttaaggttccaccagaggacatttctcatagacaggattcatttgagagagaagtcacacttttaaaagagtttattaacaagagaagagaggttcatgtgctatctgtaatttcaacaatttttgctttcaaatataattttgttttcttttagatttctctaaacaaattcaacattgtttaaaaaatgataaactttttaaaaatactgagctggcaacccagcaaataaactgttttttttaaaggtttttactccatcaagtctgaagtccttacgtaacattttattacatagtgtttctttatagtgtttcaaaaccacatatatttataactgcttaatttatctttacaagctactttgcactatacaaattgcctttatgcctctttagttgttttcaatgactttgagattaggcataacaaatattggtattataatctgacatatgagcaagtttatcctcagagaatctgtcacctgcttaatatcaggaactgctctgatggttggcaatagagcagcacacaagacaggcaaagtttctatcctcgtacagtttatcttccagaatgagatactcacgaatgtgtgaacaaataaatatgtaatataatgccaggagaataataaatggtgatactaagaccatacaagtgaccagtctcaaatctcagaactattcctagcaacttttcatcagcacaaatcctgccaagtggggttgtccaagaatagcatccccgttaagcctttctattacgcctccagctaatgctgataagtatgtatgatgtggctttactggtcacatgaggcaactttggaggcctctacactttagctctacttgtctattcaatgtagatgtgtgtgtgtcattggagagcagcagaccagggaagtaggtgtaaatgttctgaaaaggttacttaaaacatggtttgtgaacacttaagagcatgacatttactagacaccagcatggttcactgagaacaagtaagatcagcagatcaacactacttacatttgcaagagggtcatgaaagagatagatgaagacaatgcaatagaaatactgtgtctaaattttaagggccacctcaaatcattttttagggatcagtttagtgataagcatgtaaaaaatccatgaatacacttggtaaaataaacacataacaaaacatctttgtagaggcatgtgacctgcatggtaatatagttagttgaatttaaaattaatgaaataaacctaccaaaaattgtagctattgccaatccagaggaagggtgtacaatgaaaggcctcgatccttgattctgcgtggtgttttctaaaattatttaaatcagtatgtcaacaaaatgctgataaaactcgcatatgaaataaaggccaagagggaaagcttgcatgttgaaaatcttatttcacttctaagtagagtctgtcatttaattccaaaaagatctgttaaatgcccaccatgaacaaggcactgtgaaaaatgccaaggcaaggaatagctcctgctctccagcgtttcctgtgagcagccattgctgtcccaattaccaccctgttaacaacttaattgtatccccccatccaaagttcatacaacaaagtcctaacttgcagtaccttagaatgtgattgagcagggatttgtcccaggaccccctacagatacgaaactcttcagatgttcaagttccttacataaaatgatgtagtatttgcacataacctacacaagttttcccagatattttaaatcacca

SEQ ID NO: 3165 - DNA, 1911 bp, Homo sapiens
ttctttctttctttctttctttctttctttttctttctttctttctctctctttctttcttcttttctctttctctctgtcttttgtttgttcgttcatttttgagacagagtctcactctgttgcccaggctggagtgcagtggcatgatctcagttcactgtaacctccacttcccgggttcaggcgattctcctgcctcagcctcctaagtagctgggattacaggtgcccgccatcatgcccagctaatttttgtatttttactagagatggggtttcaccatgttggccaggctggacttgaactcctgacctgaagtgatccgcccgcctcagccttccaaagtgttgggattacagacgtgagccactttttctctttcttaaaacattttgcccaatgctaaattttactgcttggtttcaccatagtaatctgctctagaagaaaattaccacaggtgggattgtcaaggtgttccgggataatcatttctactttctttctttttttttttggagacaggttcttactttgtcacccaggctggagtgcagtggcgtgatctcagctcaatgcagcctcaacctcccaggctcaagctaccttcttacctcagccccccaagtcgctgggaccacagcttcaactcactccccaatcaaggtgagtgtgtatctcccatgagtgagtaaactaccacgtgcccatcacccagcttcaacaagcatcgactcactctccaatcaaggtgaaatatcagacatcatgtgattttatcgctaccatagctgcaactattaccagagcgattaaataaaggaaggcaaatatcacagcaacaatgcaccatggagacacggttcaaaaagagagaagttggctaatgtcatcaatggaaaccagattcaggagttgatactgaaaagaactttcaccaagaatatttaacccacttgaattggtctaaaatgtaagttcatgggagcaccgtgctgtgggaaaatatacctcagcttgtggggagtaattctaaaaattattttgcagatttaggtgcatcctgagaagatattaatattttgatgtagatatgcgctgtttatgaactaacaagttgccctagtaaagaactcttccaaaggctacaaaagagcacttcagaaatcctactgtgggtttagttcatttccctcccgtaattttttttttttttttgagacagagtctcgctctgtcgcccaggctggagtgcagtggcgtgatcttggctcattgcaacctctgcctcccagtttcaagtgattctcctgcctcagcctcctgagtagctgagattacaggtgcataccaccatgcccggctaatttttgtatttttagtagagacgaggtttcaccatgttggccaggctggtctcgaattcctgacctcaggtgatccgcctgccttggtctcccaaagaactgggattagaggcgtgagccaccgcagccgcctccactccctaattgttttttttttttttaaactatatctttcatctttgtaacagaactaggttaagaacaaaactccaacttttgctgttggccagacaggtattctgtgaccgttttgataaaagttacttcatcgtgttcatcatgaggtatctcacatcctccatttgtagaaatactgaagcactaaaaagacacttaactttttcgaaattaaaatatcaaaaccaggaaattgtgtatgaaacattctttttccatgatcttggtacaccattctaagtcatcgtggccatcgccgcctggttgaccattctcatttgctcttaacagagcactgtaggttactatgacccactaaaaagtgtagggacaagaaatcaatcctgattcaaacattagctc

SEQ ID NO: 3166 - DNA, 5514 bp, Homo sapiens
tatcagggctgaggagcattcggcggtggagatttaaatctgctcttgctgacgtcaatgaatgactggctgccagtccctgatgtcaccagttcagcaggcacaaatggaaatgctgggtcaattttttattttaaaaagaaaacatcctagtatccaggttttctttctcttttaaaagacaggatcttgctctgttgcccaggctggagtgcagtggcatgatcacaagtcactgcagcctcgacctcctgggttcaagtgatcctccctgatctgtctccagagtaatgggactacaggtatgtgccaccacacccagctaatttattatcattattattatttatagagacagagtctcactatgttgcccaggatggtcttaaagcttcaagcaatcctgtggcctcagcctcccaaatagtgggactgcaggcatgagccaccatgcctggcccacatcttgtcctgtcttccttctcctctcttctcttctcctctcctctctttctgtttttctcttctctctctacctatctatctatccatccatccatccacccatccatccaagcattaatatcccctgtaagcctgtaatctaagcccactgccagttatctttccagccgcagctttttcaagctagtttctttctctcttgcattgtagctcacctttcagtgagagattttctacaacctttagtgcagaacttggcttttgcagctatcttcagttctgaagagaatctcagaattccttcaagacttagtgatagtcaacctatagttccatatcaagcaatttaagcacatctcaaaaagctggtatggagcaaaaatgtgactgttatttaatagtttttaacaggaaatgcggtgagagacattattctaatggtaactaatgcaaaggtgacttacaaccctgttatccaaaagaggagttccatgctgtatgttatactccaccagtcccttgaggatggaattttatctaactgctctatctctagtttttaggaaagtgccacagaaagtcctcaataaatagtctgtgaatgaatgagcgcctatgctctgactcttaaaccagagcatctggtttacctcccacccttcttacaatattcatcttccacaaggaaaaggaaatatcaaaaataatctaaagttttttttctgttctcttcctaagcaattcaatcctaaagccattacgtggggcagagcaaagcagaagtctagagtggggagctggggggctgtggtggcccatgggatgtcagagtgcaagggggcatggaaggcgtgttgctaaagaaaatatactgcaaaaggtcccataattgtataatggcaatataccccgcaggtggccgtttacacagaatttgctgaatcagcattatccatgtgaccagtatgatattttactttcagcaggcatgttcaatagacccttgatgttcaataaatattcatgattttgactatatggagcaacctccaaaaatacattatgtgtaatgactaggaagtttactgaggcacaaactggaatcgtggcatcgtgagactggtatacagagtggatcattccactgatttgtggccttggccaacatctggcataacatcataaccttttgatcagtcatctttagcaaatattcagagtgaggaactggggaaaaatgctattaggcaactggccattttctgacctcagtcccatcaaggttgctggagaaatgctcttcaccagtcttttttcccatctcacagctacttagatataaaggtactctatgtcccattcatcagtcctgtggagaggatgccaatgttcgagagagttttcgtccctgctcttcggaccctcatttgggcttcttttatgtgacaaatagaaggattaggggtcacatcagcaaatgattctgtattcttggcatcgctgaggaagctaagggcaccaccatgattgacatacagggaaaaaacaaaaaactccaattactgcttaggagggagaactaattctacccaaaggagggaagcaccatctgaagcatgtcaaacttggcctgcaaccaaattctgccatcgggtggagtctctccttccatctgggtaataagaagttgcagatggaaaaagcctgctggactactgcatgtactatatgcctcttctgtaagaaatcacctttaaaaagaaaagtttcaaagtttatccaatttggatggagaacggcattgcaagataagtagtggctttaaagcatgtccatacttctttgacactcctcccatcaacaggggaagtctacttcttttccccttgagcatgagctattcaactggcttgctgccaacaaacagaatgaggaggaagtgatactgtgtgacttccaaggctaggtcataaaaaattatgcaggtcttgagatgcttactcttggaagtcagccaccatgctataaggaagcccaagccacataaagaagacacataggtgttctggctgacagccccagctgagatctagccaagagccagcatccagacatatgagtgagaaagccactcagctgcctccagccccagccactatctgatggctaatgcattacagatcctgagtaagaactggccagttgagcccatcaactcccagaaccacgagaagaaacaataatcaactattgttgttttacgccactaagtatggatgactgttacacagcaatagctggaacaaatgcttctggctaatttgccctttacagtaatcactccagtcgtcttatcttccatagagaaatagttctgcttatgctggagctaagggctggctcccttcaaccagattactctctacaacataggacaaaaatgaatataagtgcaatggactctgtaggcctcagagctgctgggttcacctcttagagggtaaaaggagagccatggtcttagtaaagtccccagaacagctaaagttcagtggccactgagaatcctacgtaggcactgaaagaacataataagcgtatatgatatcagcacagtccccaacttgccctttgactagaaaaggcccctctcctgccataccagctaaaggttcaacatctaactccttatttgtatttactcttcatctataattgcctggccaacatggtgaaaccctgtctctacaaaaaacacaaaaatcagttaggtgtggtagtccgtgcctgcagtcccacctacttgggagactgagatgggaggatggcttgagtccaggaggtggaggttgcagtgaacagagattgtgtcactgcactctagcctgggcaacagagcgagaccctgtcttaaaaagaaaaaaatagagaaaaataaaatctcacaatccccaaactaaaggtgaaagcagagcaagcaagacaaaagggacatataatgaaggaggacagtgggtggaaagtggctgtgcaaagcactgacagggcctcccaacttgtttccgaagctacaaacaggccctgttgctcatgaagccaactccaatatcctggagaggcatttcccaccagactcccacaaccaaacatctctcagcacacttagataggcacccaccactgagctggtgatttattgcaacactctcccttcactcctctctggggactctcagagtaggcattacatctgcccacttgtcagctatttcattcatgtaacaattatatcatgcttcaaagaaaaaaaaatcttttattttagaaagtatgtaatatgagatggccacagagtaacaaatgtgtctggtctaaaaagtgatattgtcaaatagtttagactccgcatcctaagagtttgataaacctttataaaattagccagagagacatggcaaactcagggaatggaagttgcagttctggtactagttgtgtgagcagggactagaacgtgttgattaagatcttatgcctggatcttctctcaaactaatggggtctggggtttgtaggcctctaataaggcaaagaagcagccaattaggaaaagaagtgaacgaacatctgggctgtcattctcccaaatggtctaacaccacttagccttatttagtaagtacttctccatcactccaacaataaggatgttgcttatcttgcaacaatttcaacaggcttcttcatacattcacagacatgtggaattcctaaatttgccccaatcacaaaattgtcccaatcatctttaggttgcaactccctgaagtggaaactccaattacatataactcacagtataatttttttttgtattgagacagtctcgctctgtcaccaggctggaatgcagtggtgcgatctcggctcactgcaacctccacctcccgggttcaagtgattctcctgcttcagcctcccgagtagctgggactacaggcatgcaccaccacgcccagctaatttttgtatttttagtagagatggggtttcactatggccaggatggtctcaatctcttcacctatgatccgctcgccttggcctcccaaagtcctgggattacaggcatgagccaccgtgcccggctgattcctttttttttttttttttaaacaaacaaacaaacatgctggtactgccttcaaactaccctgattgcttctctttcagacagctgaggcccaatctaggccacaataataagaattgtcagcaagttaaatcaaataagtaaaccatgggcaaatccacatagtaaatggactatggaacaaagaaaatatatctatgtatcttctttctcccatcctgctttttggaacaagtctctttgctcgggtcacattaaagcaagatgaccatatatttcaatttatccaggacaggaccccttttactttcaaaagacttctgatgtggatgatacattatagattaccttacataaaagcaaattcaaaccagccaaagaggtaaatagaactttttgatgctgactaatgggcccctcatccaacaggcattttatatctttccacttttactcatgattgcttcttgaattaaataagtggttcttccctccttaccaccagtacttatttaatcctacttttcttcagctcaagcaccccctccttctggaagccttctaagtgtactctaatctccacaggtccctcctttctttaaagttctagcacatgatttggtgcctctatggtcttaacactattttcaagttgttttcatatgtgtaggtcttcctgcaaaagttgtaagttattcaagggaaaagcctgtgtctaatcacttcctttatgtgccttaaagaatctaactctaggccgggtgtggtggctcacacctgtaatcccagcactttgggaggctgaggcaggcggatcatgaggtcaggagattgagaccatcctggctaacatggtaaaaccctgtctctactaaaaaatacaaaaaatcagccag

SEQ ID NO: 3167 - DNA, 1812 bp, Homo sapiens
gcatgatcttggctcactgcaacctccacctccagggttcaggcaattctcttgcctcagcctcccaagtagctgggattacagatgtgcaccaccacacctggctaatttttgtattgtaaagacggggttttgctgtgttggtcaggctgatttcaaactcctgacctcaagtgagccacctgcctcggcctcccaaagtgctaggattataggtgtgagccactgcgccttgccaattttattgtttttgagggaaaaatccatgatttttacaaatgtccccaacttgatctaaatcctcctttcttttacaacctctcctagagatgatgctctaatgacaaaagcagagaggtaggcaaaggttttttatgattccctctagaaattttgtttagaaaagggtacgtcatctgtccaggattagtaaaataaattatgtaggctgggcgaggtggtttatgcctgtaatcccaggactttgggaggcccaggtgggtggatcacctgaggtcaggagttcaagaccagcctggccaacatgatgaaacccagtctctacaaaaatacaaaaattagctgggcatgatggtgggtgcctgtaatcccagctactctggaggctgagatgagagaattgtttaaatccaggaggtggaggttgcagtgagccaagatcacgccattgcattccagcctgggcaactgagcgagactgtcttaaaagaaagaaagaaagaaagaaagaaagaaagaaagaaattaaaaataaataaataaatcatgtagactaatccacttctggaagaagaggaaaggtgtacttgagttaattcctgctgtgtaataagattctatattgaattctcaatgagaatatcagcctggatccctccccacaaaatgcagactctccacacctgtgctgtgcattcttgaaggtgaactagtctcatacacacactttgctgacgagaagctccaagcccagtaggtgaagagactccctttgggtaccagggggagcagagtcacgacaagcagctaggcctctggacttgctggagccttcttgccagggaacagcaaactcccacctgccagctgagaatggttttatatttttaaacgatcataaagaatatgagccaccataccccagcaaggtatattttaatccccagaaatccatggagctagaaatgctcctcaaagagatccatataatcacgtggctcagcagcacaaacagcctctcatctctggaatcacagtctaaaagattttgataattaaccttcgttttctactttgagaaagaaactcacccaaattcaaacaggtaaacagtcatgtcaatttgcaggtgagttttcaaaagctgatctggaggcattgttctgtgaaaataaattaaatagaacaaaggctaggcaaacaagtcatcgttattttcttcacaaggccatggttttcagtggtagtttttcattgacttagtagagtaggctgatatccatataaatgtaactctaaaacctccctgccactctcacgttatagcacagtcagggcatctaggcaagccacggagaattccaggtctggggcattcccaagaggccaggtctgtgaacacattctggacacctggcttagctgacctccacatcaatcctgttgtgagagtttcttcatcttcatcatctgaagtctctctaatgggttgggagagagggctcagcctctgcatcccctattctcccatgtggcatctcagcacgtgtccctcctgccctccagatcatc

SEQ ID NO: 3168 - DNA, 3113 bp, Homo sapiens
ggacagttttctggatttctctactactaacttgtctgcactgagcgtgactcacccctaacctggtgggagcgctgattggaggggcgggaggctggcggcgtgagctccagatggtgcatgtgcccttgggcttggcatgcggcgtgtcttcgtgtgaaggacctctgggagcagcgagagggctgagctgagctgagctgagctgcatgtggaggggccctcccgggaggcctgtgccctgaggctgaacttttaacaaaaccctgggaccagagggcttcagggctgatcaggacctgcagcgcttcctgctgggaagcaggaagcaatagaaagtttacgctttctattgctcaggagccgctcagtgattaaaacaagtctaaaaagccaaggggactccgtggccccaccactcccaggctggaaggcaggttcttgctttgtcagcccttcctcagcccttgtccataggcagaaggggtttttattaatacatgattgtagccttgtaggagatgagattatgtgtcttgctttgaaaattctacacaaaagcctgtttcctagttgctacagcagccctcaaactgcccatttctaaagctttcaagtagcccagtgatgcaattggaaagcccaaggcccagtttttcaggctaccacaccccatgcgtggaggctgctgggaggtctgtggtaactccatgagcctcagtcccttcctccctgccccatgggctcagaggcccagcacccctgggtgctgagagggcagggtgcccttcacaagtgggcagtgtccgggcagtcctgtcaggatgtggggtcagtcgtaggaatgccggcaccccttggctgctgagtccttagactcctgggggccactaggtgggaactgggttctacctgacagcagctgcccccagccgcagtgctagccttgggctgagtcttctgtgctagatctctcctgggcccctccttccttcttactcaagtccaaccccagatattttcagttgccgtgattctgaggatctgatgcccctggaaaggtacaacagtccccagcacccactagctggcccaggccccaaactgccaggagtggccttcttgagaccatgtgtcaccctcccagggaacaagagctcgtggctgtctgataagccaggcctgtgtgactcctcaggacatgcacccccaggtccctgtacagctgagcacaatagctcaggagtgcagggccatgatgcctgtgtctgtcttctctcctgggccacagccaccccacgtcatgctgcagcgccgcagagatcatggctgtcctctttttccacaccatgcgctacaagtcccaggacccccggaatccgcacaatgaccgctttgtgctctccaaggtgccttctccctgctcgtcctggcctctccctcagtgtcctgctctgtgctgacccagctggctaaggaatacaggactgaattgatgggttgctctgccatggagcccagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccaggtaacacacctactccccacccccaacctgggtagttttggggagtggtccttgggtgacccacccttcaccatcgcccccagactcttcctctttcctggctagggcagagtaatacatatgcgtggcctcttttgctctttaaacatccgctatggctggtgccatgaccggccccctttacaaatgaggaaacactcaggagttaagggacctgccctgggtccctcagcagtgactggcagggccaggtttgcacagagtgcgtgctctcaatcatgtgctcttcagccagagtgcttaggctgaggacttcctgttttgcccccagccctgtgcccagaccccagaagtctcagaaagacccacccccaggcccctgtctgactaggcaccaggagcccaggcctgagccacttgcctttatcttggtaaaggggagggttgtatgttctgaggggttctgggatacctgtaagccacctcctatcagcagggaagaaacaaacatttgagagattgagccttcagagggtgggtgatgagcctgaccagaaaggtgtgctgctctagcgcccaccaggtgatttgtaggaacggccccccaggaaggttctagccataagtttgtctgcggtggtcagatatggcctggggggatgaggttgtaaactgttaagaataatggctggctgagggaaggattgcttgaggccaggagttccagaccagcctaggcaacagagcaagactctctctacaaaaaatacaaaacttagccaggcatggtggtacacacctgtagtcccagctacataggaggctgaggtgggaggatcacttgagcctagggcttcaagattatagctatacatgattgagccactgcaccctagcctgggctacagagcgagactctgcctctttaaaaaaaaaattattcttttttttaaagaataatcactgtattagtctgtttccacactgctgataaaggcatacccaagtctggggaagaaaaagaggtctaatggacttacagttccacatggctagggaggcctcacagtcatgctggaaggtaaggaggaacaagtcacatcttatgtggaaggcgcaggcaaagagagagtttgtgcagggaaactcccgtttttaaaaccatcagatcttgtgagacttattcaccatcacgagaacagcatggggaagacctgtccccatgattcagttatctcctgctgggcccctcccacaaccagtaggaattacgggagctacaaggtaagatttgggtggggacccagagcctaaccatgtcagtcactcatcagaagggttcctttgccctttgggggctaggccctgtgctcagtgctc

SEQ ID NO: 3169 - DNA, 626 bp, Homo sapiens
cactttgcctgggtgtcttgcgttctgcacattccggaggaccagcttcctcatcagaagtctgactccatggaaaccagatggggcaacggggtggttctagtgcagactgtagctgcagctcctctccacctctagcctgctcatttccagctcagaaattctactaatggcgttttttcttcctgaaaaaggaaatgaacagggtccctgctgattctccaaatatgtgtctaatctgtttactgagttccatagcacttggagccatccatgcaaaaatctgtagaagagcattccaggaagagggaagagcaaatgcaaagacgggcgtgagagcttggtgcatacagccatgggccaaataaagtttccttggaatagccatgcctgttctttcacatgtcatctgtggctactttcacacttgcatgaccctgagagtgactgattgccttaaactttgtttcttttatggcctcactagtgtagccaatcgctgccgcacaacagcacagcagacacggtatcaggcaaaacctaaaatatgtggtccattacagaaaaaatttgctgacccctgggcttgcttatttgtttatttatgaagtgagattaggagccat

SEQ ID NO: 3170 - DNA, 5686 bp, Homo sapiens
gcctgtcagcatttcactgtgaataatcatacccatgcctctgctgacatgaaatgccaagcgttagtgctttggttctcagacagctttaagtctaagaatgaaagttttaattgaagaatgtgctacaaaatgctctacttgctgcggcgatgctattataaggtacagggttttttttgtttgtttgtttgtctctctctagaactggaagctactcctgtacttaaggccaggattttagaaaggagccatgagaagaatgattcagactaaaggtgagaaggtaaagaaagcaagagtttatttaacagctcttctttttttttcctcttttttatttcttccctcaaaaatatgttctcttggtgatattttagtttgtgttatccagagacctacaacaatctgatgaaaatttgtagaaactagagaaaataatgacgaataggtcaacacccacccttaaattcacatagaaagtaaatgatttaggaaaaatagttgcaactgctatcatatataaggtcttcatcacatgaataaactcttagaacttgatttaaaaaatatcaacaatccaatagaaatatgggcaacaaacatgaacaaacattcctttaatacaaataaatataaatgttaagatgttcaatctcattcataaaaagaatagtgcaaattatagttgcactgagatactctttctcaccaatcatcagattggcaaaaatctcaaagactagcaacacattctgtttgtgaagatgtgggggaacaatctcgtcaattgctgatgtgatgacagtgcaaaatggtccctagaaagggtgtatttgttttctgttgccgctgtaataaatgaccacaacttcagaggcttgaaacaagaccaacttataatcttgtagttctgtgtatcaaaagtccaacacaggtcttgctgggcagggctgctttcctcactggagactccagaggagaattcatttctttgaagttacaggacaatgcccttgttttctcactcatccaggttgttggcagaattctgtgtgctgtggctatcagctgagagccattcctagcctcccaaggcggcctgaattctttggctcataacctacttcttccatcttcaaagatagcaaaggcagactgaatctttttcaaaacatatcgctcaacaactcttctggcttcttacactttaaagcactcatgtaattagactgggcccagataatccaagatgacttcctcatttcaaaatcctgaattgtaatcacatgtttaaagcatcctttgccatggaaggtaatatattcacaggttccaaggattaggttctggacatctttgaggggatgttattctgcctaccacagatggcaatctgtcagtacctaccttattacaaatattaaattggtggaattacttttgcaccaacctaatatgtttatccttaactcagtaatctcacttttggaaatttattctacatatataggtttgcacaaacaaaatggcctatgtactaatttattctttgtagtatagcttgtcatacaaaagaatagaaaaatcccaagtatctaccagttaggcactgattaaactatggtatatcctcttaatgcagacctaaaatagtatgaataaactttgtattgttatagaaagatctctagaaaaagcaaatttatataaaatatatttcgtatgctacttttagttagtgaactgaatattcatagccttgtaaaaaattgcctaacctaaatcttcatatattcactatatactgtatttatagttgtttatccataatgacagtccatatacaaatttatatacacatatacagtctatatacatatattatagagagagagactgtatttatatctatcaacaaacaaaagagcataataagctaattaaagtgtgattccctgtaaggaataaataggcataaaaagctggagcatgtcaagggtgggaatgtgatttctcaataaaccactctaatattttgacatttgtaacctgtgattgaattacttatactgaaatacgacattaaattaaaaactcaatgagtaaagaaccaattttcaagaaagccactggaattgagggaatggatgttgttctgcaccagagtagctttatattttccttatgcattaagcagcatcttgggtaagttaatggagggcaggcatactagttgacatgggagtttgttttatattatagttaggaaaaaatgatcaaatgtaaaataatcagcaataagacttttttgtagcattgggaataatgtgagttaaaaatcaaatatatttgcacagtaaatgtgtttgaatgtctactgagagtttttcttcttttctaacattccctgtacttttcagttactatgaattccatttgaataagaggttaaatgtcattaattacaaatttaacatttcagcctagcatgagctttctagtctccacagagtataagaaaagaagatgaactgaagaaccatggcttggtactcagagccagtattgaggccatgtgaggcagtgggattgtactcaatgggtttggactcaaatgaagacagcatcttacctgctttcatgcctccctataaagagtgattttactcacactgagaccaggtaaaggtaaacaaaggaaagaacaagcattcaaaggacagagcctacaggaggaatatcctgatgcttctgctgcttggctctcctagcacatcccagtgtgccttttaaaagtgaagtccaaaaatgagagaaagacagagagagagagagagagagagagagattacacaagaacaaggaagaggagaataactactttgcagtgaagagcacaccctacaaaaccaaaatgactcccataggaagaagaagcaaagagaaaatcacatggtcatttgcagtttgatttatggtttacaacacatcacctatgactacttactgacttctttatagattgattgcaaaaccaaccctgtgagtagaaggaacaaaatttcctatcaaagattctgcttagcatcagcatggattcatttttaagtcagaaaagcatcctttctcaccaccttacaaattttggccaaccatcatcctcaaataatctctttttcacatactacctcttcatactgagatcacatcccccaaatcccagcagagaccttcagacagtgcagtggaaaacaaacagctcaaaaattagatttgggttcatattccacaccttcatttaacacctgggtgtcttcagataggtgccttatctctagatcttcagcaactttatcagtgagaagtcttcttgccctccagaactgtctgggggacttgaagagacagcaagtgcaaaacgcctgtggttgacattcaagaaagatcccttgccttggcttctggtcttgggactcaaaaaaaattcacatggacatagcaaaaaaaaaagaacccatttttaagaagtacttgctactacaaaaataaatttaccagagattacttcaaagcaagaaattacattaatgcattcttagccaggaaagacattatttcaccccacaacctcaagttttctaaaatccaaatttgcattggtagcttggcaaagcctgtgttgatatcctaggcagcacctgagaggatctcatgagtggatcaattcttcttctagagaagacaagcattcatagggaagccctacttatgtaaacataagcagaaatttctctaagatcttaaataaggtccttgtgtaatctacccatgattacctatatacacacttaaacacataaaaactttttttgtataagcctgtgatgatgtggctcaaaaaataaatacttgtttgaaatcctatcattttacttagactcaaatttatgaatcttattgggattccaaattagacattagagtgtaaagatactgttcacacagtaatgaaaaaatggtcaagttgggctcagtatatagatcttcttggacctcattataggagatgaaactagaaattggacttggaattggaactggggggtggtggaggtggtaagagacgagctacgcttgatgtaaacaatgctttttcactcgattttattctttggggaaacacacagataaacctcattaagtcaatatgggtctagtaaaaatggcccccaattctaaatagctctgattcctcagccaaatagatgctcccttattatttaattaaagcatcagataactcaaactggttcagatagtggtgatccatgctttcatattggtgaggttttccctattgtcttgaattggagtttcaaaacacaatagtgaaacagaataccaaacagtatagaccctacctgctcagaatgtccatcagtttacacacatgtacacgcacacacaggtacatgcacaaagaaacataaacacacactgatattgcttgagattgcttctcaagtgaatgaaataaccaataggtaaagctcaaaatgtcaaacataagtagagaaagccaagcaaatgaagatctattccaattgtacccttcaggaagccaaagagaaataaaacgctttcatgcagtttgtgaaaatgggaaagagaaactaattcttttactagaagcccaaaagttaaaatatgcaactgcaacttaattctgaatcaatcatgggacaaattcacttttatgatgtttgaggtagatttcacactgtaaatcacactaaaacctaccctcccaaactgcagcacactcaggaacttatccatcttgaaattagattaaagactttttgttacatcattgagtctatttggaacaaaagttttgtgaactcaggaaggtcagaaagaaacaggaattacagcaaacaaaggaaagcttgggtgaacttttctgaactttagaggtatttcaatttggttcataatgaccctcgagaaagaagatcaaatacatttttatttgcttcttcatcaagaccacaaataggtcttcacagcgcaaagcaaggcccaagtgcatgtgattcagaaatgatgtacttgtgtgggtagccagctctgtgcctggactgcagcaggcatgcaacaaaggtgtttgaatggagtgtaacttttatccagatgacccacagttctaggtctcttttctgcctttaagtaactgcagataactggtttcaatatatataaaaaaaaatctgtaacactgctttactctgtttttttatttgttctcttccgatttataaggcagcaaatgtttgaggactagtaccaggcattatgctgtatgtgggagatacatgatgcataagatgagtttccaacctcaagaaatgcaccaactatcagaagagctcacaaagtttgttttcaagtgctaaattatagaagtgagactgatccttgcaaagctttggtaggacacttcacacaaatgttgcttctctgcagcatactgacggatgaaacacctgaaaaatctggcttaatctcttttttttttctgtagacaacttaatgcaacaatttaacggtaacatagtagaaaaattccaaacacattatctagtgaataaaagaaacaaatatgctactgcaataaaag

SEQ ID NO: 3171 - DNA, 9299 bp, Homo sapiens
gtataatttaaaaaaaaaaaaagcagtggtagcaaataaagcaaattgagtgttattgccaggacatgtgttacaggctaccccccccccccccccccgaattcagacctcctgtggtaatgaatgggtgtaattgaagctgtaagattacgcaaaggagacaacagaagaaaaaatttttaatcatgatttatcttttacagccaaaaaagagcataagatggaagaaagtcacttggagaatgcacagaaaagttttgaaacaacagtacgatattttgggatgaagccaaagtctggtgagaaggagatcacacccagctacgtgtttatggtgtggtatgagttctgcagtgacttcaagacaatttggaaacgggagagtaaaaacatatctaaagaaagattgaaaatggctcaggaatcagtcagcaagttgacttcagagaagaaagtggagacaaagaaaatcaatcccactgctagcctgaaagaaagactgcgtcagaaggaagccagtgtgaccactaactaagatgaagacacatggaaatgatggcactggaggtggaggaccttgcacgcatactctttgtgaccacagggttgcaggacgttcttgaaagatgtgtcactaaatgtttgtttttgctcatctctttctgaggtcatctgcagagagtgccccatgccttctttaagaagtccctcattaagccgcaggaacaatggaaaactatttaagggaacattgcagaaatatttgatgactgtttcttgtggaagcccaaagtccactctaagagcagaagaaataccaaaatgtttccaaaatttttttaaaagctgagatttccagctttataaccaaagcttgatatatgtcacattgtcacagaagagagaaaagatcattgaggacagttgccttgggagagttcaagtctttgtcgttacacactgctgttttgattattggtcttagttttgatcctgttgcagcaaaatcctgcagcatctttctctccaataatgttgcaactcaccaaaactattcttgaagaggtccaagaacatgtattatccagactaaaaaaatgattttttgttgttatggtttacgtgatgaaaaggagaaaaaacagaatcatacctgggtggagagagggagacaaatagccataaacttcatcctggagaacaagttaccatgcaaggagttgacatcagttgttaagtgaggcccattcttgtttttacatcggtcctttgtggtttttctgggccagcagagattctgcaccccaactcccaggagaaaatgtaatacctgagcaagcacagccttgggtgtgcttggacaagagacccagcggcagagcaccttttacattttggaccgttcatgaatgggcaatgttgtgttgatacgcagccgagttctacgttatgtgctgtgactgtgcagctggacgacccccatccccaggaggcagtttccagacaggagagcaaatgcaactcacagcacctgctcatgaccttggctgataggcatgtgaagtaggatgaagcaggactctttaatgtcaaaaaaactgaagggcagaaaaaaggttccttacatcaaaatgaaagtaattacattaatagaaaacttccaagtggaatattgttcacaggcagctctttctgaccctggctcttgagtcacataaggaaaccacctttgacctctctgacacttttgtctttaagccacgtctctgaaatcttgtgaggggtgaagaaagaggactggagatgaatggacaatatgatcaaagactcatttttaggccttgaagaggccgagctttctccccccaattggtggaggacagtccagagatgagcagaaatcttaaattccttcctgatccagcctccacatgtggcctgccccttgccccagcatctttccagaacccctggacttgccaggtgcctgagcatcttcccaggatatgcctgccagccagcagcccctcaggaatgcttctataatagatccagtaatgaaagcagcaccatatcctaatctaatgtcagcttcgagaatgaagactgcagtcaggatcaaatcaagtcacagaagccatattcatgcaggtgctaaccgccttttctactggtgcaactgaaaggaatatggtaacatggttggatttttaaaattcacaatgaaggaacgagacaagcaaaacagaaaagccgagaaggaacatgcatgactaaaaaggcttgaagttgcttgtgagcaagaagctttttatgctgctttcttacatagtttctcttcattttcacttaactctgaagacaaccaaaagaacggatcaattaaaaactgattccacttataaccattgtatgctccttctagtgttatcatgcacaagaaaagtgccagttttacccatgccatataattcagctcttttgagttatgtggggccagcagaagtctcaatccttataggcttgatggtgagagcagcgggaggtttgaggtgtactcattgcagtccactttggtctgtaagtaggatgcttacgagaaatcagtgaaggtaagcagggctgccactgtggccacgtaacccttcaggaaccagtgctgaagaataatgagtgagaacacttaatttgagagttagacaaatacagcccactttggatttcatcctagtgaacagactaaaactttgcagtaaaatacctatttctacaaagcaaggtttgcctgcctcggttggggaaacctagtggttttgtcacactagtcgatgtatgatgttagtgttgtaagacaccatggcagaatcttcattattctcacctattctgaaccctgcatcatgtatctgggatgccccctcccaagtccaccaatgtaccacgttgctgacacagccttcatttttaactcaaattgatgctcagtaaaggtcaatgacaatttgttcaaggaagttcatctaaaataatctggaggccttgaaaatgatccctctaaaatgctgttgagcttgtgttcagtgtagcaggaggatctgaacttttcctggagaggaggtgatcgggatgccatttggcagcttaagcacatcctgccagcaggctttaagtggctgttctaggcatagccctccctgaactagaaaggagagtaaccagtttgctatgctgcatctaaccagacacacctgacttagtagtaactctaagaacccttaacttacaaacaactttgtctcctcttagacaatattcattaaatctgaggacacagtttgacagtagttcagattcttgcatgagcaattgacagcatcagagcacacaatatcataagttacataaattacacaaagtacatcataaattacactacagacacgttaggtaaaaagcatcaggcccgggccgggcgtggtggctcatgcctataatcccagcactttgggaggccaagcgggggcggatcacgaggtcaggagattgagaccatcctggctaacacggtgaaaccccatctctactaaaaatacaaaaaattagccgggcgtggtggtgggcgcctgtagtcccagctactcgggaggctgaggcaggagaatggcgtgaacccaggaggtggagcttgcagctagccgagatagcaccactgcactccagcctgggcgacagtgagactccgtttcaaaaaaaaaagcatcaggcccatgaagtatcaaaaaccaggttaggaggtgtgctgtatggcttttatctcaataagtggcagcttactggggaaaaagaaataagaaaaagtgtggccaagcagaagtggatgtttatgatgacggtgggggcccagaggtcataggtgatggtcctactgcccaacagttgccttttgaatccttatgttgatgatggtgtctttctacacactcactgcaactactcaggaattataaagattttctgaaatctgagaagtggaataaggaaacccagtggagctattacacttttaaatgttctagccaaaacaaattgccagtatggttgaggaattgaatatcagatggcatgcagtctcccctcccctcccctatcaaggacagtagaagctgcaaacctcttctcagcctccttcaggcacctcctgttttcataagcaccatgaagaatggtgtttcctaaatgaaaagttcagatactgctggtaaagaaactggaaaaactgaaggaaggaataaaatatgttggtggtattaacacctccagtaagataagtcattggtacggtttttctaagggccgcagtgagatgtagcagaagaaatatgtttattttgggcaaagatttgcttattggcctgggattgcacattttctctatgatgtttgcaacagagaaattttcattttaatgatactcttcctttcttgaaagttacatgtcctcatttctgtttctgcttctcccttggccagtgtcattgatgcagatcattgcatacaacagcacagcaaattgcgccaagtcagtgtgtgaatgggaattagcaatgcacgcttgcaggctctttttccaggaaccaggctgtaacattgaccggggaacctcttcattccctgacatactaaattggtcaattttgtagtactcatctccatccacaaaaacaacaaagataaaatcaatttggagctttatatgacaaaaaggaagaagtccaaaaatatatagccttcccccctcccacatatctgatccaaatattaaatatctgattttataaaacagtttaaattgtctttttaaattgctaacaagcatcagttatatttgagcttcatttttcttttatcctgtctgtcctaataaaaacaaaaatggccaaaaagtggagaggaaagaaaaagcttccactttttaaaatttgttttgtattagttattttacctttagggaccctacaactgaagagagtggagagaataaagaagtgaactttcattcatgtctgctactttgacctcataaagaaatctgcaacacagatgaaaccagtctgtgtggccaagctgatgggatttgaaaagagtggataatttttagcctttccaaaatgcaaataacttggatatatttccattttccagctatagagagaaacaatccagctgcctggaaactgttattagtatagaagtggcttaaagaaaagcatcttcaaatacttgacttagcatatctttcttctttagacttacataatgatattcatctctccattagcaattgaatccaggcataaccgggctcagttacacagcttgtctgtgactgggaagcccattttgtgtcatttctgcacacctgtccgctgttgacaccttattagaggcactgcattttggtttcacaattcttcatctcccttcccaaggaatgggcaatctactgaacttccagatcaatgctttgttggaaagtgatgaatttaagagagttttaacatgtcaaatttgaagccaattcagtatccttatttgttccaagactcttaaccaatactgtgatataaagttaggatttgggaaacgtgtagttaacaacttggaaacatgaagatattaaaatggcagctggctaactgtctcttaagccactatgcaatttctaccaatggagagattagggaagcaaattaagcctcattcagtaggtctgctgtctggtggaacttacggaactcatttcctcctctatccccagcccttctcctaactatggtgataaccagggccatagaagaccttttctctcttacctttctctgataggatcgtgtccttcagtcaagagctcatgtgaactccagactttatattacatctctgaagttcttgatgtggggaagattgacttttattccatttttatatgaaggtgttagatatagccatcaatttatttttctacattccctctacgcttatgtaattttctatttttaaatcttctcttaaatatactgagaatctctagtctccttttctaaaggctgatccaactacacttgtgggctatttttccaagctttgtgtgaaacttgatgacattgggccagcaaaatgcaaagaagactatagtttcaggcagaaaatcacgtccaaagaatttggcatggattaaacaacctctaccacactatagctctcacataggctgaacattttcctaaattctacctgtgcagacactgaggggctctctacctttgaaactatgagaacgtcttaaattaatatgaatatttctctccatgtatagtgtgagctgccaatgcattatcttaatacatcaagaaggaaatcagatttcaggcacacattagcaattgtttgttaatgtccttggcaaacgtgtacctgctttccttcattgttctcttcaggggctttcttccactttcctcttatgaaacgaatgtgtttttgactgttaactgggttcgctttccagatctgtctttcccaaatgaaaggttagtcccatagaccactggctattcagggaaattactctctacctccccatgacatggatgataagtgttgagggatgaacactctggaaactcttagcatggattttgaattccagatttctttataggagatgtataaaaaggagtttatagcatacaaaaattatactgctcttcccagtaagggactaaaaggacatttgaaatctttacattttagatgtttttgtgaattataaatatctcctttttcctcgcttcatgctaacttgtctctagataaaatcttatttcttcatacattggaccacaaggcataaagaaggtagctcagcgccactgagattgtgttctgcataatatttggaaggcttccatttccattgaaaacaaatccatgagtgagagggaaagtctagtatcaattcttctgtttgctcgcaatgacacaaataggttttggggatctacctaagggataggtctactccaaaattattaaatttataattgtgcaattctgtaatttcccaaggcataagtaatatgaccctactgtcagctagatgtcttatcttcaaagagagtatgcattaataaaaagaacttccctttaaagaaccaatctaaaatactaaaaaggcagaaacttttaaaattagaaattggataatttttaagaatctttagagaaaacattggtttatcatagtctttttctttcattgagttttcatttagactagcatggcaagcagggtggccttggactttgatttaggggatcgtgctttggcctggaaaataagcactggcctgcatgcctagaacctgagtgaaggcagtcaacatcctagtatgaatcagacctagcagaaatgtaaattatttcaagtacttcagggtttagttttcttagtgacaccctggaccctggatgctgctttctaaagtgcacctgatccatgcagttttatgtcttcatataactggtatcttgtgagtttgcaagcaatgggatgagcaagaaaaaaaggacgcatggaggagaaaaatttgaacgaggctagtgcaatgttttgctgatagattacattgttagggagctggtgattttttgccatggtcgtatcgtggacagcttttccgtggaaattcaaggcatctgtattaggcaaatgtgagtgcccttgatcttgtattgatcagtgccaatgtactgggaaagcaggtaccccagtgaaactggtctgtgcttggtttaacagctccaacaatttcagatccatggggctgcttgaccatagaccctgtttactccatgcctgttcaaaagtcattttgacttctagctttgtttcactttcttctttcaatacttctgtttcctcgtccttttccttcatattccatggctatttctttcctactttacagtttcccccagacccagattttttcacacctctgcatcatagacaactgagtagctcccttggcccctcctccatcctctcacaccctgtgctccgttcctcagccgtttggacagggagctccgctgtcaccaaggagcccatgtgagacacactgctgtgactgcctcttgttaatgtcagcatcacctcatcacttaagcaaaaaggaaaatccataaaagagatggaaaatacgtctctttttattttattttaagaagattgggcggggtggggggggggttcttattctaggccttctcaatttctcatagattttaccttaaactaattaaggccattctcttgataaatttgtacatcagaccgggtcaccagctatgatgcagaacgccagatttttgaatctcaagtaactttctgtggtgctggacaaattgacttaattctgtgcaggcaaacactttgaatcataaggatttttattgccgctccattcttactactattcatgattcaaacatctacccctgttctgaatcaggatgttgacacttcttggttattttcagatgaacagtaactgctacactcttgaaagcacttaaaagtgcaagcatgtcctaaatagccatttaacctggtaaaacataggcttttctgtttaattaagtattagaccagtctgtagatataatctgaaaagattgtaggcagtaatgaagacagttggggaaaggagaaggccctttaaagacatgaaaccttacacgctcttgggatatttttaagcataataagctcattggattcaggtatttttccctttgcatttttaaaaatacgtatttctaatttgtttgcatatttaattttgtcaaagctgagaaatgctcatgagttgaatttataaatgtcatttgcaaccaaatgaagtatttatttttaaaaagagagtgaaggaaccaacactgatttgtacataataaaaatgtgtgtattatatatatatattttttcctccttgacagtacttggtcacaatatcaagtgtatttttgtacataatatatattgattagaaaaacgtcaattgtctattcaaaaaattctatctctgtgatagattatatttatcctaatctgttgatacctctgttaatttgttttaagagaattatattttttggaatttacagagaattgcattcatggctttcaattgtaaatatgctaagggtattttaataaatcttggtttcatgtc

SEQ ID NO: 3172 - DNA, 19563 bp, Homo sapiens
gtggggtgaccataggaacatcgtcacccctactctgaacgcttactcaagacaaggtcaggcaggttctcttgaaggaggtccgaacagcatttctgtggcttacagattaggaaactgaggcagagaggtccaagtgttttggtggctgctgttgtgaggaggcatacatgagcctttgaaagattctgagatcatggaacaaaaggtttttgtctcttagatccagatttcaaataattcacagtcttttcattgttgatgtggcctggttaatgtcactactcattctgattgtcaactttcattcctgaaaggctgctgggtgacagcaggaatgcctctgcactgttggccctgtgggcattggataagcctgggtgctggggcaggcgccaggccaggtcctgggtggcctctgtagtgaaatgcagccctggttacctccagcctccatctctcctggggagattaacattattgaatctctacaacatcctagaacaccctagacaggaggtcttttttttttttttttttttttttgagacagggtctcactctgtcatccaggctggaatgcagtggcaaaatcatggctcactgcggccttgaacccccgggatcaagcaatcctccagcctcagcctcccaggtagctggatcagcagatgcgcaccaccgtgatcagctaattttcttcattttttttgtagagttgaggtctcactaagttgcccaggctggtctggaactcctggactcgagcaatccccccgccttggcctcccaaagtgctgggcttacagacatgagccaccgtgtccagctgacaggaggtcttaacatccttgtttttcggacgaggaaactgaggcgtggagaggtggagacttacacaagatcatagagcgaatagagggcagagctggagtctgaagtcagtctgaccgaccatgaaactcacatgtcatcctgacaccattccaatcctgtgaggtccccctgcttctggtaggcagctgcagaaggtgaagatgcagcactgaggaggcaggaggagggctgaccaccagctcccggcatgtccccagcaccaagtggcccagagagagcccaggatgcgcacgcaggtggatgctccgcgtgctgccctagcgggtgcctcaggaccctttgacatttcagtaccagaaatcaaatgtcgcttcagaagcccggccctccaaagatgtcacaatccaacctcccacacgcacaggagaacagcgcgtttggagggatgaagtaactcaccaaggtcacgcagtcctgcagagccaggatcccaacccaggaagtcctcagagccggccctcgccaccgactccctggagataggtctggaaacttgaatctctggaatatgcaaaatgcccccttcaccaccaagaaaggaccatcctggtccctgatccccgggggcacaacactgctgtgtgacaggggcatgacagctcccatgaaggagtccagaaccgagacctgtggagagaacatgagatgcccaaggtcacgagagagtgatgatggaaaacccttgaaggaaggacacttttcctacatgtgactactcattcatcacccaggctcatccagcagacctcatctgcaccaggcataaggacacaagggaactcatgaagcatgcctctgcccttcgagaagccctaatctcaaggctcttggcccttcctgggatccttttgaagatctgatgaaaccctgaactctcttcccggaaacacaagcacatcaaatggtaaaaatatggggtaagtgtcaagaagccctgaaatcataatttaagaactgctggtttggtgagaaagagaagcaagttgattaggcaattttaatatcttttgctaaaggctattccaggaggcaccatcagcttatattgggggttcacagaaaataaagtgattgactcagtttgaggtgggacagggtgcttctagtaggtgggatcaaggaagatatttcagaagggctaactcttgaggaatgagtggaaatttatgaggcagtcaaagggaggcaaggaggaaggtgaaccagcatgaacaacatgcagaccaatgtgtttattggttgccaggagctgggaggagtcagggttttttttctggggcaagaaaaatgtactgtgactgggccgtgcgcagtggttcatgcctgtaatcccagcactttgggaggccagggtaggtggataccttgagcccaggagttcgagaccagcctgggtaacatggcccctgtctctacaaaaaatacaaaaattagctggatttggtggcatgcgcctgtggttccagctactcgaggggctgaggtgggaggattgcttgaactgaggaggtggaggttatagtgagttgagatcacttcactgcactccagcctgggtgacacagccagaccctgtcttaaaaaaaaaaaaaaaaaagttccgtgactatatcgtgatgatgatgaccttgtgaacatgctaaaaacatggaattgtgcactttagaagggttcattttatgctacggtatgtgaattgtgtcggttaattttgcgtgtcaacttgcctaggccatagtacccagttgtttggtcaaacaccagtctagatgttgctgtgaaggcaattttttcaaagaaattaacatttaaagcaggagtctttgaagaaagtggattactctccataatatgggtaaacttcattgagtcagctgaaggccttcagggaaaaagactgaggtctctcccaggaagaaacaattctgcctgcaacttttccctaggcttcttgccctgccaattttgaatttcccttgactacttgccctgccgattttgaatttgccagcccctacaatcatgtaggccaattccttaaaggaaatctctttctctctctagatatatagatatgtctgtgtgtgtgcatgtgtgtaatatataataatgtgtataatatatatacacacacatcctgttggttctgtttctctggagaaccctgactaatacatgaattatacttcaacttagaaatgttcattaatgagggattaaataaattatagtgagaccataaaagacaagtacacaggcgtgtaccagtgtggtgtgctcagggtggcaggtacaggctggggaggaaagaaagctggctggggcaggcagggcccagacaatggctaaccttgactatcaagctgtggccctctcttgcctgcaggatagcaaatcttagttgggttatttttgattgcaaaaaccagaaactgactctggctgaagaagctatgagaagggtatggggctcacacacccagaaaatgcttaagaaccaaatccagaaactggcaggagccagggaaatcccagaaatcttggcagcaggaactcattacttggatttcttaaggataaatcagttgccaccactttttgttcttgattcctctggtcaaaatgcaggatctcaggaaagacaatgtgattggtcacatgtgagtccacgtgcccaacccttgcaccggagtgcaaggcagaaccccttgtttgaaatttctgccagttgggtggtgtctgcggctgctgctgggaaaatggggagtagaggcttgcaggtagatcagctggaatacatggcacaggtgacactggaatccctgacctgctaatgaatgaaaacagggcctgatgtccactgagttgagcaacagggcctttgttactgcaaggacgttgtccccacctccggctgtgttaggatcacagaacacctgtcaccagggaacagagctttttcgcaggtccctgatgtttgtagctgtgtgaccttagtcaacacgctcagcctctctgaaatgcaacatctgggggaaaaaatgaaagaaaaatgaagcaaaaagaagaagaagaagaaggaggaggaggaagaggagaaagcaaagtgatgaggtggagaatggacactctctctcccttctggccacaactcaattcccccaggctgtctaagtgcatcctacttctcctttgtcacattcatcagtcatcacgtcacactcattgtgaagtattctcattatcattgcgtcttgcatgccagtagactgaaagctccctgactgcagaatgaaccaacgaatgaacctatttgcacctatttgggaatctacttgcacctatttgggaatctacagatgctgcgtttttatcccatggaggtatttttgacaaccataaggaaggtgaagttcagagacaggcagccactaacttgcaggatacagctgtaaagatgagtgggggatttaaccaacccaaatgtgactgattgtagagttgtcccaaccatctggaaccttgcggccccacacagatcaccattgacatgcattacccaagttatggagtgattggtactctcttcttgcatgttaacccaatacaaccagccagatatccttaaagaaaaagaagcgagaggggctgtagcagacaggagatgtggtcttaaaatggagaggatggctaggtccactttaaggggatttagaaggtgactgcagatctgtgcaatatcccagtgatggtcactagagagtgcaggagttgcatctcctcctggggagggaatgttggctttcatctttttagtccaaaggtccccagcctgggatcaccctagggtgttcccaccaccctgggttcctcttgcctcatagttacctatgattttcaggcctggatgagaggcagggcgagtgagctccatggaaatacctgtctccacagcctgcaggtgcacacacgtactgcccaagctatccggctctgcgggccccagttccacttttgactccatctgtccttggaaacaaaagggaagaaaggctgtttcttccacctcatactttaatttaaaatttaggctatgttttctagggatgcatggaatctagtcatgacctatttgaaatactgaaagaccagataaaacctctcaggacagaaggggtgggacaatagcaccaaaatgcttctcctgataattgtcccaaactcatacctctaaacatcaccagcgctgtttcagtggaaggcagaattggtggaagaaggctgtggaagttattataattttggagctaataaaaacctctctcagacaggcttggccttggacgttacttgactcccacagcataccagatgaaatctggtctctggggacttttaaatcatcaatacccaagcctcagcaaagacaaattacataagaatgtctgggagctatggcttttggggagagtgattcctcaaaacactaacatcagatatatctaattccaggctctgccaccgctcatctgtgagtcctagagaaatcacttcagttacttgatccgtggtttccccaaaagtaaaatgaagcaaatcatggtgcaaatttcatggggctgttgtaagggttttatgatataatagctgcaaaaggccccgtactgtgcctggcacacattagggattcaaacattggccattgtaattttactgttattattcttattgataaatattgactaatcgctggctaaaattatacccttctttgaaccctggggaaagtatatgaacttgatggtagatgggcactgctgggggaagattaatggaggtgtcctgtgctgcctaaataataaatctcttctcaaagtggactccaagcagaagtgtctttcctgttatcagctggttggaaaatattaatatcacccacattctcaattggcctaaaacaccaccactagaggaaatgctaacatggctggcttggtttaagacatagactgcaaagcatcccgtaaccacagccaacattctgttaatcttatcagagggaagcagaatgctttagcagctgatggagggcagggatttaaagaattcactttactacctacagaaacaaagaacaagacttggaaacgggggctcagaagcaagaagggatgatttcagttctgatatgaccatacagaccactcagggaaaaacccaccatggatgagttccttcttgtcactatgaaataaactataaagagcgattgctataaagcatgggtggggtcattctcaatatttctttctgtcaaggtaataaatcccaaattcataagccccttcagataaggttagatgcaggcccctcactaaggtgaacctgaccttacttctacacccttcaattgagtgaccaaggattgatgagaaatatcaagtatttcataaatatttattttctaaatatacaactatagaaaagtgaggtgtaacatatagcttggatgaagggttaaaatgttaagtatctcattgagaaaaatgtgtttgacatttttacattagaacaacataatggagcaatgctcacgctaaactgggaacactaatgtgaactcaacttaaatattttcccacttctgtcactaacagtggacacagcagcagcagcagcagcagcagcaggagtagtactaatgcccaccacaactctcctgtacccctaaatggccagactttgtctctaacagttttctccacttaaagaaacaggggctctttggaagggttgtcctgagtagggtaaaacaaatggtttaagcctggaagtttcttttgtaaccagaaagcaaggatgctttctagaatatcacagggtggttctggaaggactaagaagctagattaaagaggtttcctctggtcaagctctgagattttgaatatcaaataagattgatggctataatcaattaaaacacatggagtctgtgaagagctgtaagttcctaatgaagctatgaagagaaaagttgatgtaaatggcaaatgcgatagggttttatttcatattatttttaatggcagatttatatatgggtgatattatttcttctattaaatatatgttgggttattaagcatcgataggcacttttctctatccttgtaagaaggaaagagtgaattttgaatacaactaatagtcctggaaaaaaatagaaattagtagtcatgcttggtaacatgtaaagagggaactgataacatggaaggataattggccaaatgtgctcgtaaggacagcaaactgcagggtttaaattcctcgtcttggccgggtgcagtgcctcacgcctgtaatcccagcagtttgggaggttgaggtgggtggatcacttgatcctgggagtttgagaccagcctgtgaaatatggagagaccccatctcaaatacaaaaaatacaaaaaattaaccaggcgtggtggcatgagaatctcttgaacccaggaggcagaggctgcagtgagccgagatcacaacactgcactctagcctgggtgatagagcgagactttgtctcaaaaaaaaaaaaaaaaaatccctagtctcctaggagatgaagcgcactttaggaaacactctggtctcagaaaaggataccaatgtgaaggcacggacttttatattcttaggccacatttaagctcaagtgcaataatgttgggagacactttatcagtttcaaataagaatcagtaaccccagagctggctggcctgagattatttttcttttggttctgaaagaaatttgtattcttaggagaaactgtatcacttcatactctaatcctaggaaacgatcgcattgactctaagaaagtaacagagaaaatataagaataagtataaaagtactttttaaaaccaatatatacccataatcttcatgcctttgtaaccagtgtaaaggtaagtgtgcatatatatttttcaatcagtatgacgttttgtgtgcatttttgctgactttttaggtgtttgaaacatttaaaagggtctgacatattaaacttatggttttatttaaaagtgttggagagtgtggttaaataattttgtaaacaatggtttataagtttgggaatttttaattgtttcaatttttaataagtttttgatttattaattgtgcagatagtgttcgaatgtcaagaggaatattgtttaatagatgtataaaattcggaagttaaatgttaaacaaagcacaaatatgaatcaggaacactaatcagtgctttgtttaatatttaactgattgctgagtcagttttggtgacaaatatcctaccaatgcatcacagccaagattccagagcccccatgtgggcaaaacaactcggtattacccttatggaactgtagtaaaagcagaagggacagatacatttttccttggggtatgtcatgctgagcttgcattttactatggcgattcttagaaaaggagaagtcttcatgtcttaaaggaattgatcaaatggagcttttcttggtcctttgcagaaggtgatttaattcttctattaaatatatgttgggttattaagcatcgataggcacttttctctatccttgtaagaagagtgaattttgaatacatctaatagtcttggaaaaaaatagaaattagtagtcatgtttggtaacatgtaaagagggaactgataacatggcaggataattgagggggatctttgggacaggagtcctaacctctcccccagttttctctggtgctttctgctagtgcctgctaagacctgaagtttacttgttttccatcagaactctgagattcttattttattaaaccatataatcaggattttatagtctaggaaaacatagaccattacctgctcagcgcctccagctagtgacatcttagaaatacaagcccctagttctcttagtaaccaaaggagtggagtcctttctgaaggcttgaattctatctgacactacacatttgtggatttctctgctttgatgccttcttgacagataacgtgcaatcccccttttcaaagtctaaagaaaacaggattgaaacatttgggagcaaatgccctgcaaatatggccaaccttttttttttttatcttccttttcattaaccacattgagagtcatgcatgaaacttagatctatattggtgtttcatttataggaagtgttcagctgtctgtcatttttattcaccctaagcatcttgaacatcctaccgaactgtaatcttgaaagctaatgcttcatgagaaaccttttctttttttctttagagcatacaagtgtgtcctatttaaaaggaacccaagatgccaaaattctcacatagaaacttagacatcttggcaattgttcttgcaatggaaaactgggcttggtagagagatggttccccggggaaactgaccatggtggagtcgcacagtcttgcagtaagccttcggacacaggctgagttcagagtccctagggccatctggagctgccagccagaaagtaacacacctttgtgaggatggcagcccgagggatctacactccatcaggactgccattaacagcaggtgtccttatgggactggaaggccggggaagcttgtcctccagccatgagcgttgcatagtctctcagtccattaaaagagccaaattaaaggaacatgcatccttttcctaagtctgtgatatctttctaaccattatgctcccaaactttatgataatcatgtaataactaaacaaggaacttacaaaaggtatcaaatgaatacaactacaataaagtccatttggataaagccccaaatctttacctgccccttcccgccccaggccttctatcatttgaccactgttgcctctctggcttcatcttggcaggtcccctcatgtgccctctgcactgaaagatggaggtaggtgtcttggactgaacctcccaggaggcatgaaattctgagatccttcaatgaggcttctgccatgaaccctcccctgacacctccccagcaaccagttcaattggtaccatcttccctggaggcacttctattggagtttttttgtcatactctactgcaaatattaatttatagatctatgaagatgtgggctctgaggacaggactgtgtgggattcatcgctatctatccagtggcctgtacagcacaacactcaaaaatgtttgttcaaggagtaagcaacagccactaatgactccaaacctggctatcaagtaaatagataagagccaacccggccaggtgctttcactcacacctctaatcccagcactttgggaggccgaggcaggcagatcacaaggtcaggagttcaagaccagcctggcccacacggtgaaactgtgtctctactaaaaaatacaaaaattagctgagcatggtggcatgtgcctgtaatcccagctacttgggaggctgaggcaggagaattgcttgaactgggacccaggaggtggaggttgcagtgagtggagactgtgccaccgcactccagcctgggctacagaacgagactctgcctcaaaaacaaataaacaaaacaaaacaaaacaaaaaagccaacccaggaaataaacacctttagagggcagttatatctcagattttaacaagaaatatttactttctaatatatatgtgtatatatatatatgtaatatatatgtgtatatatatatacacacacatccccagagtgaatttacaggtccaagtaacatatactttctgatatatatatatatctccccagagtgaatttacaggtccaagtaacatataggaaatgtcttcatttctcagcccaagaaaaggccatttatttactgacttatgtatttacttacttctacttttttgagcagtcttaggttcacagtaaaattgagcagaaagtacagagaattcccatttatctgtctccatacacttacagcttccctcacttcaacattccacattacagcggtgcatttattacaatctgtcaaccgacattaacacattattaccacccaaagtctatagtttacattaggattcactcttagtcttgtagggaaggccatttataatgtacattcccaaactgtctctgtgcttggtaatttatgttgaacattactgcgaggatgtggtgagaatattttcatttttcatgaatagaaggatcttgagactctttgatatatggtagagagtgatgtgttagctggtgggataacaatgcttttccttaagagtggatgtctaaagcagaagtcagcagaaacaggcgattttctgtaccaaaatttgccttacgatcaaaatttcaggcccgcagccatttcagcgggtcatagcactatcccaagaccgtaactttgatacaagccaccactgaaaggtcaaaattcaagacaaattgtcatactgctattttttaaggctaaacaaaaatttttctattcatattgtgtttatcaacagtgtgcttttaactaattagccatgaagaagggggagattggaacagaggagaagtttaccatctaatgtatgacaccaagacagttcagtcaaaatgtagagaaaacagaatctgtttgttccggctggaattgagaggacagttcaacacttcgatatttcatcatctgttattgtaattagtcagagatatgagcatctaaaaatttggaactgctaattagaaacaagtttaggctgggtgcagtagctcatgcctgtaatcccagcactttgggaggccaaggctgatggattgcttgagctcagaagtgaaagaccatcctgggcaacatggcaaaacactgtctctacaaaaaatacaaaaattagcgaggcatggtggcacaggcctgtagtcacagctagtcaggaggctgaggtgggagaatcacttgaggctgcagaggttgaggctgcagtgagctgagatcgcaccactgcattccagcctgggtgacagagtgagaccctgtttcaaaaaaaaaaaaaaagtttaaaccaaaattgttctaataatcatttcttctccctgaccccagaaaaagcatgggccacttgtcacccctcaacctactcctgacaagggggtaatattggatgattcaggatttggctctgagctgggaataggatcagtttcttctcggcagggggtggattcctgaacaaaattgggtctgttagtaaggaagtagggggaaggaggggaggacatggaggtgggctagataatcagtctgttttggctttgaggtcctttgtggctctcaaataagaaccccccacaaagaggccctgctgcagttgtgtttggagcagcatccagaacagaaagatatattgagatttcctgtaactttgtgacttctccttttgttttgttatttttatctcctctatttccctgtcttaccagcagtgagagcccttaacttagaacaacctaagaaaagctgctgtcttgttccaggacagccgtgtgggagtcacctctcagtgggtctgcagcaggagtcagggaggttcctcccagcaccgccctcctcttctagacagaagcaagtggactagcttccgaagctttgttcgaataacacttaggccatgcctggcacgcaggagctggtcaatgtgaggctgaaataaatgtgcagaaatggacatggtagagagggaagccaagcaatgaaataaaaaagcttggaggttggtcacactgagaggtgaagccagctggacttctgggtcgggtggggacttgaagaacttttctgtcttacaaggggattgtaaaatgcaccaatcagcactctgtagctagctagaggtttgtgaaatgtaccaatcagtgctctgtcaaaatgcaccaatcagcactctgtagctagctagaggtttgtaaaatagaccaatcagcactctgtaaagtggaccaatcagcactttgtaaaatggaccaattggcactctgtaaaatggaccaatcagcaggacatgggcagggacaaataaggaaataaaagctggctaccctgaccagcggcggcaacccagtggggtccccttctacgcggtggggggtttgttctgttgctcttcacaaaaaatcttgctgctgctcactctttgggtccttgccacctttgagggctgtcacactccccgtgaaggtctggtggcttcattcttgaagtcagcgagaccacagacccacggacacaacacctgggttccactcgcagcattgctgtttcctggttgtgtgaccttggacaagtcacttaccctctctgaacctccgtttattcatcagcaaaatgcaagtaataccactgaagctagaggagtctatgggaatcagaaataacacatgtaaagcttaaggtctggggcctggtgcttactaggtgctcgataaatggaagctgacttctctcatagaccaatcctcttgcaggggagggaacggtggttaacccccacacttctaggttctttgactgagctataaattaaatttacataagacagattagcagaagcaaaaacatttataattacttgcataggtatggggggcgggggttcccacaatacatgagactcaaagtagggccagatgattgaagctaatgtagcatcctgagctacagaaaggaataggggtgctttgggtttctcggagatggtggagttcttggagggtaaggggaggaaatgtatgataagtaaaggttgtctcgttataaagataaaaagcctctcgggtaatagaagctgtctctgagcagccctcttcctgatacagattgttttactaatgtggatttcctttatagatgtaaatttcttttacaaaaggacagcttttcagagctactcctgtgtctgcagtttctcataataactagcttgaaaaatgccaaagtagattttgctgtggcagattcctggtcgcctacagtcatattttggagtggtgtgtcctgacgcccaacgcagtctaattattttctaaattcctgtgccatatcctagccctgtgtcacctgcaccaacactaccctgtctcgttgctcatgccacaccctggtgtgaggctgggtcagagaactggcaaagatactgggaccctgttggcatcatgggatttgtgggtcagcttccctgggggtgaattgctgaacaaaattgggtctgttatcaaggaagtgcagtcgagggaaaggaggaaatagaggggggctttgtggatgaagtggcaagagttcagtctgtccccttggaagaccacaggtgtgggatatcatgagtgcaggtgtcactgacggcccccatgctgagctgccaggggccctggtgctcagccgaacctctgctttcccttagacttcggtgtgaggttgctttgattattaaaaactcctggcccctccctgatttctcaggggtgatgactttattggtaagaaggtagactctggagttggccagagttctaattctggttccaccattgactggctttgtaacttcgggcacgttgcttttgcctccctatgcctcagttttctcaactataaaatgggcataacactggtacacattttacaatattagtaacaagtacagcaactgtgagatttagccagctaatacatatgacaacatgacatccttggcacagcgtctgcaaagcacttaataaatgtcaattataaacaattctcagaaaaagatatacaaatggctaagaaacatatgaaaaaatgctcaacatcactaatgataagggaaatgcaaatcaaaaccacaatgcgacaccacctcactcctgtaagaatggccataataaaaaatcaaaaaacagtagatgtaggtgtggatgcagtgaacagggaacacttctacactgctcgttggaatgtcagctagaacagccacgatggaaaacagtgtggagattccttaaagtactagaggtagaactaccatttgatccagcaatcccactactgggtatctacccagaggaaaagaagtctttatatgaaaaagatacttgcacacacatgtttatagcagcacaattcgcaattgcaaaatcgtggaaccgacccaaatgtccatcaatcaacgagtggataaagaaactgtggtatatgtagatacaatggaatactactcagctataaaaaggaatgaattatcagcatttgtagtgacctggatgagattggagactattattctaagtgaagtaactcaggaatggaaaaccaaacgtcgtatgttctcactgatgtgtgggagctaagctatgaggacgcaaaggcataaaactgatacaatggactttggggacttgggggggagggtgggaggggggcgagggataaaagattgcaaatggagtgcagtgtatactgcttgggtgatgggtgcaccaaaatctcacaaatcaccactaaagaacttactcatgtaaccaaacaccacctgtacaccaataacctatggaaaaataaaattttttaaaaagtcagttattactgtgatcatcagagacccccaatttcaccccatcccttacccaggcgggcggacctacaggactgtggggcaggcgccgccccagcgtcaatccacccttgcagttttgcctccatctgcctggggaggcctctcattgcgagagctttcttctgaatctcacagtggctctgtctggtttggactgagatgattcccatcttgtacatgagacagctgaggcccagagaggatgccttccttcagcagggtctgagcatagtctgcagcaggaggaggattgagtcccaggtctcctgactccatgtttggtgctcattccatcccatcctcagcgtctggagaataacgggggtgggccggcagaggaagggtcaggaactgcttccccaaacccagctcctgcaggaggccagaaaaggctctgacacttccaccccatagccttcatgcctcccacgtggctgccaggaggcctctgacggagatgtgaaaaatgaaccagtaaatgtatcatgacttgtgaggctgtcttaataattaagttttattaaaatgaacaccaagaaatttcctgacatggtctgcctggtggaactcatcaaaaggtgataaatgagtgggttcaggggaaagaggatctaaaggaggaagtagggacagagagagaggccccagggtggagaagagagggaggaggcagggggaggctcaggagccctgagcagcagttcagttcagcacctggcccgctgcttccctgctttgcttggaattactgctgagggcactcagggccttgcagactggcatgtggagccaagcttcagtcacggcggactttaaatcccagctgggccactagtaactgtggcagctctccttcctgggtcttcctccctccctgagctgtgaaaagggagatggatcagaacaaactaccctcgcccttgaagggaagtggatggccatccatttatggaaaacttggtcatccgatctggtctgcagacattgactaatatactcaccaaacagtggtttcttctggacaaggtattgggactggggagggtgttgtttagagcaactctcttatttgggttttccacaataagcattgattgcttttgtacagaaaatgaatgaacacttccaccccatacagattctagagcacccaaccgatagttcaagatagggggcgagatggagcacagacccctcttaggagcctgccaggcactcctctccccaagcatggaaataaaggaaaatctagaaattccaggcacgtagcaagccttgaaaagtaaatgcgcaacttgacaagcaagaaggtaatagtagcttaagacaatagccaaggaaattagagtcataggatatttggtttcctgtagaaactaaagataacatctcaacctacgtccctgagttgtgtttcagaaacccagacctccaccaaatggaaagtgccatctgcaggcacagagaccttggataaggggaagctgaggaccgaactccaaccaccatgctttctcctaagtttcttgctgagggacctggaagagatcatgcccacgggcaagagctaacgttcttttctgcctacaccaaaattttagacaaaacttcacctccttaacccatcacaacactgaaaaatctttgaatccacctttcacttgccacactcccaaacttccgcttcaagatgctttgcctttttaggccaaaccaacacatagtctccatgtattaatttatgattttgcctgtaacctctccccctctacctttaaaaacccttacctgtaagccatcagggagttctgatcttaagcatgagctgcccaattctgcttgcttggcgccctgcaataaatgcctcactttctctggctgcaatcccaatatcagtgtttggctgcactgtgccgggtgggcagacccaagatcagttcggtaacaagagtaaaagtctgctgagagacaggtcctgcccttggggagctcacggtggtctaggggagagggggcatagggcaattctgttacaggcatgttgattctgttgtgttaagggctggggcagagggaagcccagagtggctaatgtggggcatagggaggagcctcaggaaaggtttcctgggcaaggggacacctgagctgagatgtgaagaagagctcttttactatttagtagaagagaggaggaaaggagaaagtgggggccagatgtgctcaagtgaaagtgcagaggcctgaatgagcactgggaattcaaagacgggcagctagttctgtaggaatggggcgacagctcagattggctcttccattttcacacagggatatcaattccactatctgcctggctgataactctgccctcaatcaagaataacggcattctgggccttgccaggaaatacgtgaacctctgctgtccctatctcttattaagaaagagagaaaagctctattgaaagaattgttatttatggaggattgagtgaaggacattcattctgcaagagtataggttttatccatgaatcaagtcaggtcatcagaaaacttgcacccaaggacagagagatcaatggaagagaatggaaaggccagaaatagacccagatacaaatgggaattcattgctagataaaggtggctttgcaatgcagcaaggaaaagatggctcacgtgttgaaagccggagagtaagagatatgagaactgagaagcctctagcgggtttggtaaggtggagggcattggtgccctcagaaagcacagtcttggtacagtcagtagctggggaggcaggaagtagagacagtgagaggatccactcttgagagaagtttgggcacaacccagaggggaggcatgaggccacaccccaaaggcgatgaggaagggagagagggatgttaatctttattcttatgggaaacatgaacatgtttttaagatatattgttttttgtttgtttgtttgttttgaggcagggtctccctctgttgcccaggcaggagtgcagggcgtgatcatggttcactatagccttgaattcctgggctcaagtgatcctcctgcttcatcctcctaaatagctgggactacaggtgtacaccaccatgctcagctaattttacatgtttttttgcagatcgggtctcactatgttgcccaggctgatcttgaacttctggcctcaaggaatcctcttgtctcagctcccaaagcttgaggattacaggcatgaaccaccacacccggctcaagttatcttgttaagcacaaaagcagtacagaatgttagatgcagaatatatctctttgtttaaaaatggggctggggagagattctatgcttatgcaaataacatttctgggcagaaacacaaggaacttgtaatgatggttacctctgggaaatggggcaaagggcttcagctttttccttacatactggttgatttttttttttcattatagccattaaaaaaattttgtttgagacagggtctcactgtgtcttccaggctggagggtaggggcgcgatctcggctcactgcaccctccacctcctgggctcaggtgatcctcccatctcagtctcctaagtagcggtgtgccaccacatccagctaatttttgtgtggttttttttttagtagagataaggtttctccatgttgcccaggctggcctcaaactcctgggctcaagctatccacccacctcggcctcccaaagtgctgagattacaggagagagccactgcacctggcctaatgatattttttaaataataaaaaaactattaattagatgccctcaagagcagctcttaggcgccaaaaatattgatgaaaggtttctttgtttttcaaaattaacattcaatttattaaagtaacaaattcatatggacccaagttcctccataagctttgaaattcagcttacgaat

SEQ ID NO: 3173 - DNA, 1712 bp, Homo sapiens
cagcaaggcaactggaatgaaagtccctcctgtcattcattcaaatccaagatcgccacccaggcaaccctcatgcagatggctgagtaatgcagcagccagcaccagggctccaaggaggggcaggaaagagagagaagccagttcctcgtgtcctcatttcaactgactgtgtgttcctggtaccctgacttttcctggttcctgcaactccagactcctgctggggacagaagaaatgtgggtatttcccggtcctcttgtcctctccaggctttctgattttgagcagggtgagtactatgctagtttcccagattctattttcatcctgctggtgctggatccaactctggacattacagcatatcccagcaaagctgtcacaggctggccaggaaacataggacgggagggacagaaggagggggtgagaagggaagactgcagcttcctagcttctccacccacagccaatggaaagggctctgaaggtgacttatatggcctttggaacccaccaccagggagagaactcaacaggtgcagactgttgagcagactgttgagggagatgataagggaagagaccaggaactggaagttgggcaacaagtcttctagccagggatgttgtggaagcccatgcttcataaccttatgtggataggcagtcgatggtcttatctgcatagacccatactctgctgctgacatgtgcgcctttcgggtgatgacgcagtcctttctgccccattacctatatacatgtgcagaagttcttcaccatactctagagtccaacttatttgtctctttttaaaacgttcagttaggaggctgggcatggtggctcacacctgtaatcccagcactttggaggctgagatgggcagatcacctgaggtcacagagttcaagactagcctgaacaacatggcaaaatctcgtctgcactaaaaatacaaaaattagtcgggcgtgttggtgggggcgcctgtaatcccagctactagggaggctgaggcaagagaatcacttgaacccgggaggcagagattatagtgagccaagatcgcactactgcactccagcctgggcgacaagagcaaaactctgtcccaaaaaaaaattttttttggttagacagtaatctatactcctagtaaaatcaccatcatcatcatcatcatcatcatcatcatcacccagccctggcttctttatattaaactactgcctcccaaagataaaggccagatgtactctttgccataactttcaccacattcatataaccagaggcaaacactgtttttgataatattttataaaaccatttcctgttttataaaactggattcatgctgtgtacatttctgtgaagattgcctttcacacttcttgtagttttttgccaggccaaaaagtgttgcaatagacatcctcaagtacagatacttttatttttatagagtagattctgagaaatgagattgtagggccaaagggtatgcgcattttaactttttaatggatattgccggatcactttccaaaacagttgcggttattcctgttcccacgggcaaagtatgcaagtgccttttcccccaatcctttccggcaccaaggtgtcattttttctcacttttaagcaaatagattgcatgaaattatcttactatttcttaaaatttcatttttctggc

SEQ ID NO: 3174 - DNA, 2853 bp, Homo sapiens
agaatacagtatataatacatataatacagtatataatacatattataattatataatacatataatttcctgtttatgttatctatcagtaaggcttctggtcaccagtaggtaattagtagttaaaatttggagaagtcaaaaagttaaacacagggttttgactgagcagggacttgattcccttaacccttaccttgttcaagggtcaactgcatattataatatctttggggataaggtgggaaatgacttgaaatcactcaaccagaggattttaaaagtgtgagggagaaaaactcaacttagtttagatgttcattgattcgctcacatattattgtgtttctattattcccaggaactatactgctgggaatactctgataagagttggacagagtctctgccttcatttagtgtgtacactttataaataaactttttaaaaagatgactactgaatggagtccatttatttaaaaatgaaccagacacagccctggacagaaacttcctgatgagatacatgaaaattctgaaatacaaaacataatgaattgtaaacatctttctatccacgaaagatggtcatgaatattttcagagttcccccatggagaagactgcaaaagctgttttgatacttgactttccttgcctgctttatcacatttgagaaactacaaatggagtcaaataatctcatttggagtcggctgagtaaatccagtaatcctctaataatagcgacctcaggattaatttaaaatatagacaaataactcacctaaaaatatcacctctgactgaataatatcaatcaggagtattttacaatatagacaactcacctaaaaatatcacgtttgactgaatatacctttgatttttcaatgtagtatcctgaagatatatttggtgtaacagctcttcaacaaatatttatagtgtcaggcagtgttctaggagttgtgacacagttgagaacaaaataaacaagtctctgctttcataatgtatacaaacggtaataagcattaagaaagagaagaaaaaggaggcaggaaataggcatagagtgagattatagtgatattttatataaggcagtaaaggtggacctttttgatttgagatacctatttgtgcacagacaaatgaggaagcagaagctgtgtggctatctaggagaagagagttttcaggcagaaagaatgggaagtacaaaggatgaggaacattaaggagacagtggggctggagtagagagagtggtggcagaaattaggatcagagagataagacattggattgtactttttaaggtaaaaatttacatttaataaaatgcacatatcttaaagtacacaagtaaaatgtagaatatttccatcaccctacaaaattctcctgtgaccccttccaattaatctaattgccccacaggtgaccactgttctgtttttttttttaatcaccatagattcattttatctattttgaactccatatgaatggaatcatacaacatgtactctttttttttttttgagatggagtctcgctttgtcaccaggctggagtgcagtggtgcaaacttggctcactgcaacctccacctcctgggttcaagtgattctcctgcctcagcctcccgagtagcttagactacaggtgcatgctgccacgcacagctaatttttgtatttttagtagagatggggtttcaccatgttggcaaggatggtctcaatctcttgacctggtgatctgcccacctcggccactcaaagtgctgggattacaggtatgagccaccgcacctagccaatatgtactcttttgtgtctagcttcagaatgtttattttcagagattttgtgattaaagaacaggtgcatattttactatgtaaaatgttgccatatcagtttttccaaaatggtgtgccattttatgcacccctgcaatgtataaaagttctagtttcggttgatgttactgtcttttagtttatctgttttagtgagtgtgaaatagtaatttttttgcagatttaatttgcaaaaaaattaaacactttctgagaaagtgatattaaacactttctgagaaagtgatattaaacactttctcatgtgcctgttgggcaatatttatctgcttttgtaaagtgtctgtttgagacttttcctctattttaattgagttgtcttgttattattattgattagtaagagtccttcatctgttctggttgttttcatggtggtatagtgtctctcttatggtggtttctctggtgagcattgtcatgggatatgaggattgttatgcttggtgcttattcccattcatcttttcatgcatctatctcagacttcgttgttcctgatcttccaatctttcttcttccaggtgcctaagtagctggctcagtcatttgccattgtccatgaatttatgtattttctaagcttggctcaggtaacttctctttccatacaaagaagatgaccaggtcactgcccaaaactttgctcacttggaaatttcctctcattcctgtctttcaagtatcaagggatactgagccaatccatttgtgaaccaagctctgacttttttctcccccatcaactggtgataacaggtcttccacacgatgtgagagagaggcactgatagaatagtagtagatgacattggtgtctaggctatctgatcatgtagactgcatgtcctgcacagtcttgcctgtgcttgatctcacatgtaccaattctatcttcttatggattacttctgggcctgctcaaccttatgccttggtgggtctgacagtatac

SEQ ID NO: 3175 - DNA, 2549 bp, Homo sapiens
gtcattgatttgactattagccttcacaatgatgcttcattgaaagtatcgcacattgttacattacataagtgaagctttaccacctcttatattgcaggtttagctctgtctcaatcctcaacaagaacaaagaagaagggaaggacaggggataagagtcaagtgctgagaggcaaatacaagccttggaaatccattctgagtcacaaatctctctcaagaagtgggccaaggttgctgttgccactatcccatgctgtccaagaactgaggccattcttttgctttctgtatttggaagaacaagtgccaaaggcaattcaaataaacccagtgcccttttcacaatcttcttttggagaatcgtacaatcaaagtgtaatattcaaaaaaagttggccaacccctgcctagagctgaatagaggaagaggagttgagaaggtgagaggataaccaagcacagtttgaaaagccatttggatatctgctttttatctcttggttttccctagtgtgttttacatttacattcagatttagagctctaagccatgggagaaagcttactttcttcttgtgttagctcaggtcctctgaggagcagatgccaagacagtagtagacctgcaagagagttattggagacaactctcctgtagggaaaagcagaggaagctggaagaggcagggaaagcccactctggaaggggaggaaaaaggaaggaaagttgattgataggaagagtctcacactgcagcatagtgctgagatatttcagccaggccttagagtttgcaagccaaactcacccatgtgaggagtcctgcccctcactggaatgagctagtcttaccaccagaagcggggctctgtgagaacacagcagcctgctactatactgtataattaagtataaattcaggtctggacattgagtctctctcattccattacagaactattaaaaaataatcctgtattaggaaggttgtttctaaggcataaaaatcatagaacagagataagaagccttggaagctacaggccatgctactctttcagatttatcttgtttccaacctgcccacaatggttgagtggccattgtgtatacagagcactaggttaagcaatgtaatgagaaggaagaatataaaagattaaaaagaaaagtcactgaattcaacagggtgagtataactttggatttgctgacagagggacagtgatacctgattttttttccatgcagctgattttttaggccattggctatgagttagacactcagagcacatatagaccaggaaaacttccctcctgactttgttaagtgccctctgactcgatagaccacagaatgaagaatctattttatgttggtctttgagtcacttccaccttaacttcctctctcctctgctgtccagatagaatgtacattgacaagagtaaagatactttatacaagccaaattgcttttgagtttctgattattattgctgcttcacaatggaaacaggcagagataaggaagggatttcaaaaagatgagtccatataatgttatttcacaatctaaatgcttggctttcttcatttcttttctctctttctctattccaaactccttttgtcaaaacttgattaaggagccactatggccaccagctgaatagtgaatacagtataatttactatcaccccaagaatgtcaaagtatttttaaataaataagtgaataaattgaggttgatattgataatgtatttttgctccctgttcaagctccttaactggatgacctggaatctcaagaacttgttggtgattgctttaaaaagcagaattcttctagaatacactgtagttttagaattagaagacacccttattccatgcaggaatattaccaagtcagcttttattgctttctaactagatcccttagagatcaagatagcagttgcggatccttgttcagcttaaatttatgtcaccttctcatatctctgtccctcactgccatttaataaagctctgtcatcttttgtcttttcctccaactctaaatgcaattagaaagaagacagagaaaaggagaactaactttctgtttctcaaaagttaatacctgtagcttccaaagcctcttacttctgctctatgatttttatggcttatcagcaacctttctaataacagtttgctggtggaaatttttgctaattctacaatagaatgagagagacccaatgtccacacgttaatttataattcattatatggaaaagtagtattaatagcattgtatttgcagatatacttttaaggacaagcattcctaccttatgtaagacccagaacttgctgatgatatgaattttgtaaaagcacattctgaagttgagcctcccacaatctcaccacccacagtgcccatcccaggaagtgcaagcatgtggaattcaaacttactggaaataaataaacatgaataattttaaaagatcagaattaaaattaataaatgattacagct

SEQ ID NO: 3176 - DNA, 2754 bp, Homo sapiens
ggaggaggataccctttgaggtcctcgggggacttgcaagcagagcagggggtatggggagagcataaatggagatgagactctgttcacactctttcctgatatccctgtgttttcaaagagaaaactgtgtcaaaaccagggaaggggaggggggaggtgaaaaaggacattttccaagaactccaggcctacagtccttagtgcaacagtacctgttgtttacaaagattcatctgcctctgtcctgcatttccctccgtggacaccagggcactgtctgatcatctggtcttctcagtccccggcaaagttcacggaccctgacacaccctgcagctgtctcctgaaggagtcagagtggaccactgaatcccagctgctcttctttcaaacgatgtgaccttgggaaagttacataacctgtctgtggctttgttttcttccttataaattggggtaataacacctacgtgtaaaggttattcaggtaatgtatgtttaaaagaaaaaaaatgtaaaaggaggaagtgaaaatgaggcagagtttgtgtcctgtgaaaggtaaggaaccagtcacaacatactgataatattaatagctagaactctctctgtagctgcccctgccgagtgttttataccattatctcattcacttctcccaactctttgaggaagagactgttgtacccatcatatcatcatacaaattgctatacccatcatacacataagaaaactgagactcaggaagtgaagtactggtccgagtggcagagctggaattcaaagcaagccttagaggctaagcactggcatttctgtacccatcttgggggagagctggtagctggctccagggaagcatccagcggaagacctggtcttggctgtcctcgtttgacacctactcttagtaacccagaagagtgcaggcacagtgggtattgcaaaggccggagaaggaaaccaacacagacatccgaaaaagctggtgcagagcaggagagaggaaatgggattcagtttggggaagtacagaccaagctagccacacagagctaatccacagcaaggatagagaggtcaggagagaaaaaaaaagaggagagctgggagctgaaagcagcgaggtggggtggctggctgtaactgagatgctgctctgtaaagtgatgaggccggggaggccacatctgctctgggcagcactcgcagagctgttgcagcacagagaggtcttgctctcctcttcacgtgcacagtggggaggccgcattcgaggctcagtgcgtgtgcgtgcgtgcgacacacacacatgctttgatactgagccccatgaaacccccatgagtctttttttttttaactttcctcctttctaagtttgacctatatatttccagatgcctctaagggaaattatggggctattgcatttatcgaatatggagtatagatcagagtggatgtggaggcagcaaggaaggaactgaaaaaagcagcactcagccatgctgatgagctagtcccaagttccagatctctctttagcctgaagctccgttccttcctgtccatctagaaggcaatgttgcctaaaggcaagagcctggatttatgtacggctcctgcttttactgcctatgtgaacttaattattctaccttatctggttcaatgtcctcaactttgaagtgagaacagtagtaatacctacctcctagggcttctgagaagatgaaagaccaaagtgccgctcctatgcaaaacctatccttgggaagtggagatcattattgcctttaaatctgtccaagggtttaataggagtgcattcacaatttgtctgtaggccttttattcagatgcctttagattttgctaaatcagacattgtacagattgacagattgaaatccatagtgaaaaaaaaagctagtttgagggctttcttctggagctgaaataaagcaatcctaacctttgggaagctggttaaatgggttcagagtagagcatttctatgtacctctggggcatttcaggcctggcagcatcaggagggttctcacatgtggcatgggcagcaaagctatgtggggattctgtctttcccaaacctcactgccttccatgtctcctaagacttggtaggatattcaaatacgacacacctgtctctcccagcacacagattatagctgtaggtcttcccatgacaaggtgtgggggaaatcaagtgagggattctgggagttttatctttcccttgatttggggggcataatgcctgctgggaatagaaggacggatttggacacttcagctggctgattcctgggaggggaaaaggacatctctggccttctagccagaaggggcctctggatcacccagtccagcttctagaaggctcgaggactagcattgtgtgtttgtggtcccttgtcagagtaagtgataggagagcctactcaacaccccaagactcctcagcgagtgcactcccacttcatcatcctgagtgaacacgatgcctccaggaatgtgggagacagaagccacagcggattcttttttcaaacccaagcaaggaaaatcagagagaagcaagtcaaatgccattatcttctctctgcagaactgactaagcaaaattatgaataggccaagaatgacttttctactgattgatgaacttgaatctgttcttctaggatttgattattcaattaataaaatatttac

SEQ ID NO: 3177 - DNA, 5796 bp, Homo sapiens
cattcatcatgttactactcctgaaagtgactgactcaaggaccttactatagatcactaagaataaaagccttccatgatattcattgtaacttcatattaattatggaataagttttccacaggactttttctggaactgagtatagtggcacctggttgtttgcaaacatggactgcgagcaccgagccaaactagattggcggccatctttgctaccacatcaagacagcctgccttgagaatgaagccagcacagtagaaagtagatccaaaatattgagagagaaagagagagattatttgagttcagcttccatgaagtgctcaggccctgtctctatgtcaggttttcttagagcctgtcaatctctcagcattgattttacaccaccacatggggtccttcctaatcccacaggcctcactgtctccagacttacgtcctctttcatcttgctgccttctcagcaaggtaaatccccaattcttccttcagcatgcaataactacaataacagcaataacactaataagatcacatatctaaggagtgttttattgtgtgacaagcactgttctaaacatattcaatttattgtctcatttaattctaacaaaaaaaaatgtagtaattattattattaccccaatgtggggtagtggaggcccacatacattaagtaaacttatctttatctactttttaaggacaagttttgtttgtttttaaaattttttttgtcttgatccttcaggtctttgccttttgatttctaaaacacgttttttctcctaaggaaaaaaaaaatctcgagaaagaagaaaagctttgccattcacatcagtttactctgaaactagttttaggagcttatttcagaagtcagaaactgaacattgatggatgattctggatgtttaggggaaaggtaacaaagaatatggaaaggacattggtagcactgtacaacgggaactactggaaacagactcaagtgccaccaggaccctctttccagcactaacctatgtgcactttcttctcttttggtggcctggcctccttaccaccatgaaaaacatgtcctccagcaggtcctcagagtcacatggtaacttttgccaccagaaagaggctgactcttttttcctacttgcagtttaaaataaaaattccaaaaaaagactctcattgtcctggcctagagcattgtcaccctgggttaatcaaccatgccctaggcttgggttcgcaggagatgatggggagatctttaagaaccactttctagattcaatctccacccccacccttccacgatttaagtggaattcaacaatttctatattatcatcaaaataaaaataacgatttatagaacctcaagaggctcacctaactgaactgcagtcagaggctgtaaccttctggttaagttcagccagtgggaaacctcagctgagaggcagagggagtgagaagtgtgaggtggagctgtttatttccctggctcctgcctgtgagttcatcacagcctggttacattcttcaaccaaaggacagaaactgctcccaagggagccctctccacatgacccttctgggatctattaaaagctcttcctctattccccaatcttggggtgggaggggtgggctgacaaccttactttcactggctgaggggtgctgcactatcccttgtgattttctacagcccactcagaacttcctcctggaattattttaactatagggtgccatatgtttcatttgaccctgacagatacagtcatcacaaacaaacacttattactagatattgacatatattaaaagagaattgaatagaattcttgatctcattccttcatctttatcaattcaacaaataatgactgggcttctgtatgccaggccctgggcacatgttcatgtcatgcaatgacattagtatatgaccaaagtgatgatatggctaatattcctgggatgcaggaggaagaagattcatttgaagcttctcctctgaacgtggatgaaatgtggtcgagaatataagctctagcatcagataaacctgggtgtgcaccccagctctgcctctctgtgtgattctgggcaggttactcaatgtatataaatctctgtttccccacctgccaaatggagataacagtgagattcacctcagagatctattggaagactatataaggtaatatgaagtgcttatcgcactgcctgacatgtagcaacggcttaataaaaagtattcattattatatatgtatacaatatacagtcatatatcatatataatgattatctataaaatttaattctatttaaattcagaaatcatacattaaaaatttcttatgcctttagcattgtattagactctgaggaggataaaatccgagcttgcttaccatttcactggaaacgcaggtatgctttagccaatatcaagtggattaggagccaggatggcagtggggacccagtgcatggaaaggagggacatttttacctgagaggaggtagagtgctacctggagaagaagacatttgagatggtcttgaaacatgagtggctgtttctcagatgaacaagatggggaaagatattccatttgaaaactaaagagcaagagtaaggacacaggagcacctttatagacagatggagcctgtgaggctggagcagtccacaagaggggcactgtggtagcgggagaaggggcagtagggaatcacactttagacctcgctaaggggaatgtcatttaagatctggtagatagattggagcgggagatataagaggtagagagccagttataaagttgttgagactttgaagtatgtccacaacaatggggcctgggaaggaagagactttcaaggtcaaaccccagcagtattgaacacacttttgagatagtcacgtaaatgtacgaaaatattgtcttcttgttctctctcagagcacttgacaggaaacctaattagagccacttgtttctttcaatagagtccacccagaagattaaatccctccatgtttccatactcttttgattagcctatggggtgggtgggtgtgatttgaaattactttttagaaataaattttatgtgtattttcaggtcctcccaaacattttcctgtggtcaccgtcaatcatattttgaaagatgtagtaaccagctatctacaagtagaagaatatgaaccagagctctgtagacagatgactaaaaccatttctgaggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacatagattcttattaaatatttgttttggtactaattattttaattattctttaattagagtgttacaatttcctgcattgttttttaataaaaagaagctttagaaaaactatggctatataccctgaccaataaatgatagtagaatattcaacatggtatacacaaatgataaataatgtgcctcagtgctgcatataaaagaatactggttttcattttgtacttaataaattgagcagcattcattaagtgcaattattgttacatgtacctgacagttgaaactgctgaggtagaattaatggcttcataacaattatcgtggtcccacgggctgcaagctaaaactagaagctcttgtggcttgcctgcactttacacaattgtgggagaaccgaaagttggctcttcagtaatggaaactataaagtgaataaaggctttttgggacactgaagtagacattgtgatattaaatatacatgatgcttaatactaaatgtgtctgtaacacataaaatcatttattggaaagagacattgcttttaaatatcctaggctaacaaactttttcacaaaatatatggctggcaccttaacaaataaagcatgtgtagttaccattttactcctatgaatttaatactaaagtgacccagtgaggtttttgaatagacgggtgctaaaatttacagggctgaaatagcttattattctgctggttaatgtatcttacgccacggatcatttatttttatgaagctttcaagtctttgtgtgcaagtaaaatgatgttgtggcgttgttcttggatggtaagtggactgcctagaggacatttgttaaaggtcaaagacaaattgtacacatatggagaaaattagcaatgctgtagtcttaaggaaaaaatgatttatcattcatatcaaaaagagtttagcaaatggaaaaccagttaatgctttaattttaaaatgttttggtgtcttacttttccctaaaaatgacatgtagtaaaaaatggatacttttaaaatcccttcccttctgctattttctggcttttaaagtgattattcaaaatgaatttgtcaattttcacttttttttttctgttagtgcattagtgggaatatgtctatgtaataatttatcacaaccaatatttgtcaatctccatagaacagttttcaatctggattagattacacgtataacaagtaaatgagcttcatattttcattacacattggtgaacatctcccttcgtggaacaacagcgggggtaatcatatcactaattttgtatgaataaatgaaaatgaagaaacttctttaacatatacaaagtctattgtaacaatgactgtttgttttagagttctaaattctaatccatgagataatttcttactgtcttccccaggctgtgttgagaatcgaaactgcaaaacatgacggcagttaaaaaacaaaaaagaaagcagtttgccagcatattgctacacactgtaattcagatactcagtgatgaattctagcaattatatagcagtataagaatacatagtaaaaactcactccttgcaactaacttgggagaagctagttatcacacagaactttatcatgagaaatttttaatgaaattatcacacagaaccttatcatgagaaatttttaaaacaatgacactataaatttgaaggaattgttttactttgaaatgccctgaacttccctggtatttttttcctctcctaaagtgccatccttcttcccagaccagccatgcccatccctgctccagagccttcactcatgctttcctaccttggaacaccccctcccacttaagccactttcttcgcttttcagggtcacattcaggtcttaccttttctctcagtccttctctattcactgcttgcctcctgctctctctctcctctgattattctcgtggttgagctcttgattgttctctagctaacttttgaattctagttttgtttcccttactattaatagactgaagacatattgaggacatggacc

SEQ ID NO: 3178 - DNA, 685 bp, Homo sapiens
ggcagatgccacgttccagtatgttttatggcacaaaaagatcgtggtcaccagatggctgttgcccttccaggcttccagctcctgtgttccagactgaagaagaggaacagaaaaagggttccaccttggcatggtcagaaacagcagttgactagtgaaggaggaaatgaatgaacaaaaaggaagatctctcttttctacagcaagcagtagtttctcacagcatccagcatagtgctggatgcagaaagtccaagatcaagatgccagtgggattggtttctggtgaggcctctctttctggcttgcagatgctgccttctctctgtttcctcacatggtctttcccgtatgtgcacactctcctgatgtctcttcctcttcttatgaagacaccagtcctatcggatgagggttccaatcttgtgacctaatttagccttaattatctccttaaagaccctatcttctggtgaaatcacattggggattagggcttcaatatataaatttggaaggggaaccctgtttggttcataacaccacctaagcactacttcctcaaggtttctcaaacacatacagtttagtcagaactacctgttgtacagttcccaaactataaataattttttaaattacttgttcaatggctgtctctcctagtagtctataagctcca

SEQ ID NO: 3179 - DNA, 3116 bp, Homo sapiens
gaaaggaggagaaggagggaagataaacatcaaacatgttcagcctctaattttaacaatgtctgtatcagtcactgtatactcactaaaaacactactgccaaaatattctaaatctaggggcttactttagaaggttactatgtatcgtttcaatgtaaaaaatacccacttatcttaaaaggaagtgtgatgggaagagcttttaagagttattgtttgatactgtgataggcaaataatgtccttttcactgtgcattcttaggatggaaagtcaagatttgtggcatgtgtgtgcatgtgtgcatacatacgcttttttaggtatgcgtatgatgggaggtgagtagataatttttctccaggattttaaaagctgcgtatttacatctcttcctaaatcaagcacaacaagaaggtgttaaaagtggtgaaatataataattaacgaggggaatggaaatcaaatgacaataaaattacatcatacacagacgagagttaagtacttgtgtagaggaattaaaccgattaaggttttcctgcatatagctccatacacacattacttccataactttaaataatatattttgtttttttgtcctgggtgtattattgaaataagtacattccctcttactcgttcttctcaaccccagatccattttccaatcccccactgatcccatgtcagcatgctctgtttttgactagacaaataatacacagatttatttctacaggaaaaacctctggtaaagtcatggagtgcctacttgaacgatattcaaaaggaaaagaagagatggaaggaaactgttgcttcattttctgttcatggaaggggagagagaatatctgagtttggtgggagcaggcacagacagcagaagagttcatctgttccacagtatcagcttactgagcaacgttatccagggagccctatacctctggccattgctgattagacaagaataagcatttggttatttgtgacaaacctgatttttttccagtgattcatactaatagtgccagagatattccgaggtattcagagatattgacaccttaaggttatatattctaaggccagtggccaatttcatctatgtttaagttaataattaaacagggaaatctggtgctattgtgtggtctaataaataaaatattctgagtatttggcttaatgagcatgccttggaatgagtggcagatagagaaaggagaccagctacctgcttactttttagttcctgggagtcccggctactctttctttcagtcagttggtgagattcccttgtgttcatcggatacattcattttttcttagctaatttatgttcattaaaataacactatccttaaccaggaagaataataaagtgttccgtaacatacatatttagattagtcttcactctgaatttcttttgtttaaagtgattcaaagaaaccatttagctttagattgacacatttccaggggaggattttcacctaaaagaacagactgtggaaagacctacgggcttatgtgatgaaggaaaaacaaagagaactcaaaagatgaggaaagaacttgaaagttaaattctgttacttcatatcagtaagtgatttcttctatataatttacactgtaatattctttaaatgaacaaaaatatgtatatttgtaaaaggccctatgcatacactagtaagaaatgtgttaaaaatgaaagaaaaatgctgacatgcctaggaatgattatgataatgataacgattgtaaatattatgggccagacactctaccaatacaacaaaaataacagcaataaactttacatggatgataacattgaattctaacaacagttttatgaatttagaaatgttatgtctattttatgaataaggaaacctagacttagagcggttaaatcacagtccaaagttatacagctgtaatatggtggattcaaattgcaaaatcaactgagtattgttttagagtccgtgatcttaagcactctgctttaatatacttagaggaaaactttcctcaatttctggagatgaagaaatggaaaattatccaacctagtggcaatgcaaaccatctgagaaaggagagtctgggagtgtggctgtctgagacacatcatttcatcccagccggtgctcttgggaagaattaggactttgtaagaaatacttaatttgaaaaggattatcttgacacttctgtggaaggtcgaccagaaaaaagaagatacatcataagactattttagtaattcaaatgaaatgaaaatgtccagtttggggttataattatcaaggtttatagaagctggtaaaggagaaaaattgttacagataatttaaaattttgagtctggtggactgaaaaaataatgatgccattgggagcaaaagtaaaattataaagtgtctgttttttgatgagggaaaaaatatatttcactcaagctgtgagcaaagatgtgagatagatcttttcttattcaagtgaattatcttcctgttctgttctagtcaggctttctgagtgtgcaggtcagcatctcaacctcaaattattcttttagctcgtcttattgtggtgtttgtcttgttctttgagactgtgtcttcttatctcatatccattcttcattagctggatagtacactatcttatatgctgatatcctgtcttgtatctcaaaaagatccacggttatggaggccagtagcttaacccagtggttggagattctaactagtagtagctcttcggtgccaactttatacatacttggattttgacttactgactgatacgcacaattcttgtagtgtcatattgtttaccttccaatatgtcagcttgataacttgcctcagataaccttgattctcaaaggaacatcatcatagatgtctaccaagtttccaaagatcagccatttccagtggagcagattgtactcgggccatagtccaaatacttattttctttaatttccctgtatattcattatgccttgatgttacttaatagatcagatatatttattacacatttgcctatatattaatacacatgtg

SEQ ID NO: 3180 - DNA, 1245 bp, Homo sapiens
gtccaaatgtgtgtgtctccctcaaatttgaatattgaaattctcacctacaatgtgatgctatcaaaaggtgaggtcttcgggagaagtttacttcttactgggtggagacacttggcatttgtaaatgagaataccaatttgaaggaagataagaaaaagaacaaaacctcctagcataaacaggcacccccttctgcaggtctcagctccggtgaagaagaaggccagctgcccagcagacagggacaaggagtgtgcccacatctctggggcaggtacagctgtcctaggaagtggaggcacctgctgagcttgtacaaaaaaggccgcttgggaaggttgaagaaatccagttgcgtgagcttgacaaatgattagaggagaaagaaaaagagcccgcaaaacccacgggcatttgagggaccgaccatccgcttggagtcaactctatctcataaagaacgaagtaaatattccaccccagcctgaggactctcggcatcttggcatcttggggtctgcgatacatcaaagggaaaggatgaagcattgtgacaactttaaataccaacggcagcgcctattcaaggaaaaccacagaggggctgccttccttacccagaacgccaattctgtttcctaggaattactactaagcagctttttatttcctgcaggaaccctccctcacttttttttaaagatgggaaaggagggcgatttagggagacttagccttaaaagctcgttaaaatggcactggctgcagcgggaggatggagctggaagtgccctgtgctgtggggcggggactgtcacctcagggccctgcaggaagccgcattctcccaactaggtccaaagaggactcaggcaccttcggagaggcccttcccaacttcctccagagattagattagcaaatggggaaaatagtagatttttattaaacattaatgaatctgaacttttcttccaaagcaggttcaagttcaggacacatctttgacagcttttagcagccagctcagtgctggaaggtgccctccatataaatatttttaggtgatgtatcatttctgatatagaagatgatggaatgtggattttaggatctgggttcaaagcccagctcttcagctgtttgaggctgagtgatgtcaggaaaaccctagtctgggactctctccatctgcgaaggtgccttccttttcacagagacgttaggaggctaaaaccaag

SEQ ID NO: 3181 - DNA, 2983 bp, Homo sapiens
gccaactttggcccacctttgccaacattcattattttttgtctttttaataatataatagaattttaaaattctgactggtataagacaatatctcattgtggttttaatttgcatttctctaatgattagtgatgttgagcattttttcatatgctgcttggccatttggatgtcttctcttgaaaaatgtctattcttggcctttgcccactttgcccagtttttagttgagttgttttgctgttgttgttgagttccttctagattctgatattagtaccttgttggatacatagttagcaaatcttttctcccattctgtaggttgtatgctcactctgttgattatttcttttgctgtgtagaagctttttagtttaattaaatcccatttgtctatttttggttttgttgcttgtgcttttgaagtcttagtcatgaattctttgcctattcaaatgtccagaagagttttccctgggttttattctagtatttttatagtttcaagtcttacgtttaagtctttaatccatcttgagttgattttttaatatggtgcgagatacaggtccagtttcattcttttgtatatgcaagccagacttcttaataagaaagtgatacttagctgcagtttgaaggatgaaacagtttgaaggatgaacactgaaaagaggggaaggaaaggctttctgggctacccaattctctctgcatttcccagtcctgagggaatgtcattgctctaagttctccttttatatacacacacacataggttgcctgtggactgactgcttcagattaggtgcccacctttggcccagagagctgtggctgggtgagggagagttcctgggtcctgggctccttaacaagatctaagcaagtgacaacttcacttactggaactatggctgtaataattcatttcggggacacgctgctgcctccaagaagcttccctagttcccccaagcaaagtgattgctcccttctcttttcttctcttgtatcttatacctgcttctgttggttgcacatatcccacagattgtttcgtttctgttgttaacatgactctctgcctcccaagtaggctgtacttcttgaggacagaaaatatgtcttatttatgtctgttttcctagaatctagcatagtgactgtacagtgcctagggtaagcactcaataaatgatgctgaatgaatgaatgaaatgacaaactgctactggagtacttctcaaaaatgaatgaaataaagaacaggagagtaggcactctatcccttccttctctttctcttcccaagtcaccccacaaatatgtgtcccattcaacatttctggtacacatatttggcacatgtgacatatgctatatggacaggcaagtgtgatggcaaatatataccagtcatggaatgcccgtgctcagcaaatacctacatggcattttagagccaacccaagtcctggcatttggactgggattgagtatggaaatactataggaaataaacagcaagatcttatggtgcccaccagtggtgcagatttgaagtaataatacagagtggggggaaatagcactaattaagctgaatggctcaaagagcaataccctttctcaaaccaattctgtaacagacctggttcttcaattttctattgttggctcaattctaactgtgctgagattccatccatttctgaagtggttttatttggtgagggaggaatgcaaaatgactacttggcccggttttcaggtcccacatgttgtttggtttttgttttgttttattttggattttgttttaaagagtctaaaagggcttcattacactggaatctaactacctatttattttctttactgcttccattctgcctgaagttagttaccataataaatgttgttctccaagctgtgcatatattatccatcactgctaggaaacaaagaaagatgtgttttcctgagaagactgctgttgttaaacaaagcagcaggtgtcttgaatcagaccgtgtgggctgattaaaacactgtgattctcctcctgactttgcctttcatttcttacacttcagctcctacttctgattagaccaagtatgtccttgggagttacgtgcttagaaggaaaaacatgtaacaggaaaaatacctacttctctataattgaggataataatgttcagcttggttcattaacagggtatccttctggtaaggagtagaataatccttctatctctttcttccagattgtattctggcagtcacagccctcaaagacctgcacgagaaccctttccactagcttcttttggtggctgggagtttctctcagggtacagtgatacatgcaatatgcattcatcaaactaaaatgtgttgaaccaagcctcctctggtccaggtactgtacccaggactcgaaggatcatcgactgccaatcactttttggcaccatacatttgtgacttctgcaagatggaaataaacagctgtgcatagctgaaaatggcctcactctgttgctcaggctggaatgtaatggcacaatcatggctcactgcagccttgacctcccaggctcaggtgatcctcttatctcagccttcctggtagctgggactataggcatgcgccaccacacccaggtaattttttgtattttttgtagatatggggttttaccacgttgcccaggctggtcccaaactcctgggctcaaacaacctgcctaccttagcctcccaaagtgctgggattacagacatgagccactgcacccagcctatctttataacttctttggtgaaatggcaattcatatctttccgtgttttatactgggttgtgtgtgttcttattattgagtttcaatagttcttcatgtattctggatacaattcctttatctgaggtgtgatttgcaaatattttcttcctgtcggtggc

SEQ ID NO: 3182 - DNA, 1433 bp, Homo sapiens
gtgactgtccagatctggagcattctgaggacttcagagggctgcctgtgcattgatgaagagcataagaaagaagacaatccttgctgttctggggagacctcagggatgttcccaggccacatttccagacacaagaccacagaaccccagccaggagcggccaccagcttttgccgggggcttcaaaagcccacgtctgcatcccggctgcgtccccgcaagaactgcgtgctgcaggcaccatctgcgccgagctgggactgagccggcctggctcccctccctttcagcagggcagccccacaaaggagagggcctgccagccccaggcagtgcagagctgggagctgcagactcactggaggctctgggaagctccaggaagggatgtggaagccaggtgttgaagcgtttttcaagcaagtgacaggggcatgggccagcttggtggccacaggaccacaggactgcaggacctcgggtgcaggtcttaaagtgcctttcaagcaggttacagggcatggacaagcttggcagccacaggactgcaggacctcgggtgcaggcgtggatcagcttggcggctgcaggacctcgggtgcaggcgtggaccagcttggcggctgcaggacctcgggtgcaggcgtggactagcttggtggctgcagggctgcaggactgcaggacctcgggtgcaagtgtggaccagcttggcggctgcaggacctcaggtgcaggtgtggaccagcttggtggctgcaggacctcggttgcaggtgtggaccagcttggcggctgcaggactgcaggacctcaggtgcaggtgggcatttcattatcatcgctgctgtttgcgagatgatgcttggggtggttcaagcagctgccgggacatcatgaaggagggattccacctgtgccaaccccacccggctgtgtcaggatcacctggggcttttaacagtgcccggactccagcccagaccaatgaggcctaaatttctggtgatgcccaggtgtgagcatttaaaaatatatatatctacaagagattccattgtacgactaagattgaaggtcattgtggaatttccgtcaggaaaatggccctgagttttacagaggtcactttggggttggtgcagggcatggaccaggcgggaagggctgtggcagaggtggggccgtctgtcgggcggcactgaacgcccaggcggctgccttctcttctacatccagcctcctgctgcaaggacacagaggcccaggacctcctcccagcacctgagcaccaccctgcttttgcccatggacacggaagtctccagctcccaggccccctttgacatcgtcaggtgtgccaggccttgattcatctagcctaaaacacagcgtttagcaacagttcacttgaaatataaacaaattcc

SEQ ID NO: 3183 - DNA, 1062 bp, Homo sapiens
ccagcctcctgtctgctgagcaagtgtggggtcattgtctcatttatttccctacttctccttcctcggcttgcaaatagtggctctggcctctccactattggagcatgagaagacatgagatgagagctgctaatgattgacagatgcggtggtggttcgagaagttttgcaaaggagaagagagccttgaagatgaggagtgtagtggcaggccatcggaagttgatgacgaccaattgagagcaattatcgaagctgatcctcttacaactatacaagaagttgccaaagaactcagcatcgaccattcgacggtcatttgacactggaagcaaattggaaaggtgaaaaagctcgataagtgggtgcctcatgaggtgagtgaaaataaaaagatcgtctttttgaattgtcatcttctcttattctatgcaacaacaacggaccatttctagattgtattgtgacatgcaatgaaaagtggattttttttcctttctctttttttttttttttttgagatggagtcttactctgtcacccaggctggagtgcagtggcatgatctcagctcactgcaacctctgcctcccaggttcaagcaattctcctgcctcagcctcccgagtggctgggattgtgccaccatgcccagctaatttttgtatttttagtagagacggggtttcaccatgttggccagtccggtcttgaactcctgacctcacatgatccgcccaccccagcctcccaaagtgctgggattacaggtgtgagccaccacacccagcctaaaagtggattttatatgacaactggtgtcaaccagctcagtggttggaccgagaagaagcccccaagcacttccctaagccaaactagcacccaaaaaatgtggggctactgtttggtggtctcctgccagtctgatcaaccacaactttctgaatcctggcgaaaccgttacatctgagaagtatgctcagaaaactgatgagatgcatcaaaaactgcaatgcctgcagccagcattggtaaacagaaagggcccaattcttc

SEQ ID NO: 3184 - DNA, 809 bp, Homo sapiens
atttgtggtatattcatcccatatattgataatactataaaatttaagttcatacaatgatatgaaaaaatctcagagacacaaatttgagtacaaaagctagatatgagggtgcatatgctctgcaatttctgtcatataaaagcaaaaatgaaaaaagctaatcaatggttatagaagtcagaataatgtttattttaggggggataacatctgggatgggcctgaggcagtcttttggaaagctggtaatttgctattactcaatctggatggtagttacacagatgtgtttacttttcaataattatgaagatgaactattatgatttatgcatttttctttctatatactatattttaaaataaaagaaaatgaacaggactattcttcctcaaacaaagagatcgtgtgatgaagactcaccagagctgttctctataagcttgaagagcaatggtatcaggtgcttttttttctgaagctttggtagtgtaactgtaagagtcctggaattggaaaagcaaatccagaagttgagttccatgacttttttgctgtttgcctttggacttgcatcatttatatttttaattcatcgaggatgagaaaattgattaacacaaaatcttttcatgtcttttctgatgagagactagctgaatccaagaagagaagcccttgaagagtgtattctattctagacaagcattcacacattggcttctttggtgccaggtaattagaatttgtaatttggtcttaattaaactgcagactacccaaaggccttgatcagtggcctttt

SEQ ID NO: 3185 - DNA, 3405 bp, Homo sapiens
cagagcccggcagaaggctatcgaagagtgtggccccagagggaacccctcagcccttccttccccagtcatcctgaccctgtgccccaactcgttcctctcccagggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctatgcagtatttgggaaagttcacaagaaactgagaagaaacctaaaaactgtggatagtggaaagatttttagattttttttttccttggggaaactggcaggcaatgggggttagggaggttggggcggtgggggctttcttgagttaaaggggcttatatgtgatgtcaatatttcttcctctgagaaatggtatatatatgtgtataatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccacttacaaggctgctttccaggaagggaggtctggtgtatctcatgggagaatctggggtgtctgtaatgtcacccctccagcagcgccacaaggactgaggttgggtaggtgtggggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgataactgagatgggggacgccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcatgtccaccttggaatctggctgaactggctggcaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaacttt

SEQ ID NO: 3186 - DNA, 11424 bp, Homo sapiens
tgttaaccaactattgttaaattttaagggaaattgggtagcatggtcttaggtctgattataaatgtttgtcttttttgggagcctgtgattttttcaatacaaagcagcttttaaaacatcttgtgagaacggtatttaggaggagaacaaaaaagggaattctgaattgtaatgacagatgtaaacatgtctttcattagggttcactttggttttctttttctttagtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagacttgataaagaaggaaatggatataaaatattgaacttcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctgcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtctatttgtgtattgtagatgtatcaagtgatttctaatttttttcacatatgaatgtgccagattactctagaactagatgtctcttctttaaataattttagttttcctgaataaatttgtaatggttaaagtaccaagtaagtaaggcgagaagggattctgtttttaaaatcacatcagaacttttcctctactaagattataaattaaatgtaaaatactcctaattgcaattcttaaacttaggccttacatgtacttattatgcaactgctcctggactctattcaccatagatatcagtaaacgtatgtcccaggattcacaggcttttgattaatcaatattcttttcaagtttgctgtgaagagtttagttctcttcaaaatttcttaactaatctgatttttaagaattctctttgcagtgtttagcttcctattcacattcttaaaattgctttggtgttaccatgagtctaaaatgaagtttagccttccttttgtttcattctgagaacttctatattatattacctttaaaaattgtttatgatattaaatttaaaatacaaacagctctctttttttttttttttttttttaatcatccagcccaaagtggcaaaaacagctcttttctcatttggcaccaccaataacgcaagttaaaaataatgttgagtttattatacttttgacctgtttagctcaacagggtgaaggcatgtaaagaatgtggacttctgaggaattttcttttaaaaagaacataatgaagtaacattttaattactcaaggactacttttggttgaagtttataatctagatacctctactttttgtttttgctgttcgacagttcacaaagaccttcagcaatttacagggtaaaatcgttgaagtagtggaggtgaaactgaaatttaaaattattctgtaaatactatagggaaagaggctgagcttagaatcttttggttgttcatgtgttctgtgctcttatcatcacacaggtcatgtgttgttactcaggattctggaagtactaagccgtagttaacaggctggatagatcttcagccaatcttctttcattatactgctgcttttctgtttcttaaaaaacaaaaatcaatgaacaacttcttcagaaggaagcaccactgttcaattggttaactgaaagtatgaatcactgccgctttgcttgcccacctgtttgctttttctcacaggttttatttatctgaatgattgttgcatttgaatactgtagccatggtgagtgagcagttgaagacttcctttctgcaccttcatagttaagggttcatcttctcaagaaataaagttgtgctgggttgtttcaattctgtagatcacctagaaactaggtaacaaggcccttggatcacaatgagcacattgcaggtctttggaaatgctgggaaggggttacattcaagtaactgctgacgtccttcctctctgtcagacccatgttggcctgtaattatatttttctgaatctaaaaacaaatagaaatttctgatatcttttcagtctccttcttttctttccattcatcacttaaatctcattattgtataacgtttcaaattatgacctggattgaaggaagtctgttttgtcagggactttgttaggtgaacatcagaatctcaactacaacaaagctgaaaaatgaggcagccttaacagtaaatgcttttgggccgggcgtggtggctcacgcctgtagtcccagcactttgggaggccgaggcgggcggatcacgaggtcaggagatcgagaccatcctggttaacacagtgaaaccccgtctctactaaaaatacaaagaattagccgggcgtggtggcggcgcctgtagtcccagctgctcgggaggctgaggcagcagaatggcgtgaacccgggaggcggagcctgcagtgagccgagatcgtgcccctgcactccagcctgggcgacagcgagactccgtctcaaaaaaaaaaaaagtgaatacttttgaaatgaatgctttttgaagcttagaagaaccattaggtttatgtaatgcacccatacttattcctttaaataaattttaatttaaaaacattgagatattggcttctgtcaacctgatttaattaattctttacattaagctgattttccccctggcagctgacaaataagttcattgttcttgtagaagtgagctcacaaggttaaatgtgaatgttctcaaaggtacacagccttgtttcagaagaattttaatgcccgctgtaaaatcaatcatgcagagccaatttgaggtatgactccagggtatgcaaggtatgacttctctggaagccaagtcttttcacagggcactgtggtaatacccatagcactaatcctcagtgtgctggttgaagaaataaaatgtttttaaagaaggataaaggaggaattaattagaaaatttttttccacatattagcaaataaatgaaatgtcattttcatattaagtaagtatagttatgatcttcgtttctacctactctccttttgaaatattctttattactaaataatattttaggaggagttaacagaaataattacctgtaacatctgcagataaacttacatagctaacattgtgtgctgacttttttaaatggtgaagtggcattaatgagatgttcagtttacagaatttgaagtttgagttctattttaatagtctgccgtgtcccccaaatcccatttagataaattgaggttgatttttcacatagacttgcaatttttagacaccacattttttttatagtaacagcctcatttgcctgtacaataactaataatacagtatttcataggtacattgtatgtgcacaggaaatttttctttaaatcttaagagcctttaataaacgggatattttaatattttaatgttactacatttaaaaaatagtgttttcctacaaaattttctgtattcagtatacgttaactatgaaaatgtcaaacaatgaaatcattgaaatatatttaaggaaaaattaccaaccaaaagtaatgagtaccctctatgtgcatatttactggaatgttcatgtgaaatggtaacatttccaataacagcattttgaatctggggtgacacaaacatgatttttatttttgagctagggattttgatggagaagcacctagatgaagacaccatttcattcatgatattttaaaattagaaaagtaaagcttctaaattgaaactcttaacaggtcacttcatgaaatttttagttttaaatttaattttacatgagatgtctttctgaagagctacttttattaactttcacttagatcgttgtatgctaggcattcagtatttctctacttgattttcctatgcctagttgtgattacagcaagtatttaataataaagtcagtcatgtgagagtatccattaatttcagtgggtccttggaaggcaggcagaagatttctgtccaagagtcttatttttgacatgagatgaaattctttttttttttttgagatggggtctcactctgtcacccaggctggagtgcagtggcaggatcttggctcactgcaacctcccaagctcaagccatcctcccacctcagtctcctgagtagttgggactactggcatgtgcccccattcctgattagtttttttgtatttttggtagagatggggtcttgctatattgcctaatttttgtgtttttagtagagatggggtttcaccatgttggccaggctgctcttgaactcctgagctcaagtaatctgcccgccctggcctcccaaagtgctgggattacaggcatgagccaccatgcctggctaaaaccaattctttagattgtttttgccaccatttgcttacttggaatagctttcacatttatttttcttatgaagaaatccagtgtcagtcagaccatgtaacatcaaagcaaaatttcattgaagcctatccttgtcttaattattctaaaataaagtacaataaagtgaattattttgccctttgtagtagcatagtgttaagttatatatatattttaatatgcatactcctaagtaaagtttcagagaccacatgctggagagcagtggctttcagacagcatcagcatcacctgaaggccttgttgaatacacattattggaagagaggggagaacacaggctcatgcctgtaattccagtgctttgggagactgaggcaggaggatcacgtgagcccaggagttcaagatcaggctgggcaatacagcaagacccctgtctctacaaaaacaaaaacaaaaaacaaacaggcatggtagtgcatacctgtagtctgagctgcttgggagtctgaggcaggaggatcacttgaacccaggagttcgaggctgcagtgagttattattgggccactgcagtccagcctgggcagcaaagtgagaccctgtctgttaaaaaaacaaaaccaaaaacttgattgctgggggccaccctagagtttctgattcagtaggtctggcggtggggatggtgggcctggtaatttgcctttctaacaagcgtccaggtaatgccccagctgctggtcccaggaccacactttgcagattattactctgagaagagcactaactctgacgttggattccttctgttcctcattagtgaatttatttgggggagattattcaatctggtagatccgcatttacttagctgtgaagtggaggttaatgcaacctgcctgagactgtgagaatgagaaactctaattgaaataccaggcccagcgtgcctggatgcttgaaaaatgctgactcccatggtccgtccttccctcactcttctcagctataaagtgagaagcgaaattcagtatcttttaagattcctctcaggtgtaaaatgctgtgattctaaaagtttaattttgtagttccagagacaatgccaaacacctgtgtgtgcttagtgctttgtaaagagtggtaataacagtgacaccacataggccgtagttttgtagttccagagacaatgccaaacacctgtgtgtacttagtgctttgtaaagagtgaataacagtgacaccacataggccatagttttgtagttccagagacaatgccaaacacctatgtgtacttagtgctttgtaaagagtggtaataacagtgacaccacataggccgtaattttgtttttgcttttgttagggtgttcagcatcttgactccttaaataaggttttcagtcagatttataaagcagcattgaagaagttgtattatatttgagtacagttggaatccatggcagttttatggaggccaaatatatcagatgaataggctaatttccctgagttgctggccttattagtccctactctgttgccccctggttacctaatgcatgttcaaaaggtatagttttcatcacctgcttgatcttgattttcagacagcatcaaatcagttgcaaaacaaatccaagctaaaattttgagtgtatgattaatttactatagcatgtaattatgcagtattttattttttattttttattttttttgagacagagtctcactccattgcccaggctgaagtgcagtggcacgatctcggctcactctaacctctgcctcctgggttcaagtgattctcctgcctcagcctcccgaatagctgggattacagacatgcaccaccacgcccagctaattttttgtatttatagtagagaggaggttttaccatgttggccaggttggtcttgaactcttgacctcaagtgatctacacgcctcggcctcccaaagtgctgggattacgggtgtgagccactgcgcccagctatccagtattttatttaaaagttgtcactagggtgttcactattgtgaatttataatcttaaaagttggggatgctaaaagtaccagactaaaatactacgaggttttctcatcttttaattccattttgttagaaaaaaataatcacaaccggggttcttttacctttccccagccatctagactgctttactgcaatgttgggaagattgcatacaataaaaactgtagctagttgattgggatttgggaaaattgaatcaagcatttgcattcatccagaatggtcttaaactgctgactgtggggtgcccacaggatgagcactggtggcatgggtgggaggaatttccttggatactgcaattgcatttgaaagatctattttccaaaacctgagcagagagaggctaggaggaatgcagacaggacattgaaaatgcgaattccctttactagtagaacatgaaatatctgataatggtttaaaaaaaataagtgccaggatacattgtagtataaaggttcaactagtataatttaaaatgagtctttatattcaggccaggtgcggtggctcacacctgtaatcccagcactttgggagtccgaggcgggtggatcacctgagattaggagttcaaaaccagtgtgaccaacatggagaaaccccttctctactaaaaatacaaaaaattagccaggcatggtggtgcacgcctgtagtcccagctacttgtgaggctgaggtaggagaatcgcttgaacccaagaggcagaggttgcagtgagctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaaacctcaaatctgtccttatacaaatatttgatttctagtttccttttattaaaacattttcactcattcattctttcacaccttagtctctaagatgtgtctcgggtatttgataaagtaggtcttcttgtggagcacatcactcagctttggagaccaaacattaaacacactgagttgcatcttatgcatgttaaggtctaaagccaaaaggtgaaatttttgaataatcaaattgcccttgggagggtcctgaataagagacctacattccatctcatgataagtcccttccattgaacttttcctccaaaattggaatagaaattagcaacagcagaaagccaatgctatccctaggatggtggggtggagggaggaagccgtcataaagctcaaggccagggtcacccagaggaagcacaacccccgcagcagagcacaggggccttcagggtgctgcagctggaggcaaagaaggagggaaagaaatactctcgctttgctttgctttttgccattgactcccggtggcaggagctgactggaagccagctggcacaggagcttggagcttggtggtatccctctggtgtcgactcccctgacttagagcagagccgcagacctcaggtcaagcaggctcagaattggcacatttgcactggggaccatattgtatggacaacacttactttcaacagtagaatcacagcctgcgaagatgtcacagtacaagaaatattctggaaccaagatcacctttatccatgtcaagtccactccagaaagtggaattaggggaaagtacctgccctggactagtatttcgaatcccttccctcctctacttactcccctttccctttttcttctcccaagctgagctaaagggaaatgtgaagaacattattgcctctttaaaaccaaacatatataaaacatgaaaaatatttttcagtgacaaaagataagaatgaaagcattcaggatagtgtattcatagaagctttgggaaagagtaaaaataatttcttaaatttttttcttgaaagactgaaaatagaatcttaaggagatagtgttcttaaagccttgatctgactacttgactacttataacttctttcttcatctactaattattttgaaaagtcacttagtcatttgtcaatcctaacctttagagataaacatttaaaatcagttcactaatcacagcatttttttttttttagatggaatcttgctctgtcgcccaagctggagtgcagtggcgagatctcgggtcactgcaacctctacctcctgggctcaagcgattctcctgcctcagcctcccgagtagctgggactacaggcgcacgccaccacacccagctaatttttgtatttttagtagagacggggtttcaccatgttggtcaggatggtctcgatctcttgaactcgtgatccgccctccttggcttcccaaagtgctgggattataggcgtgagccaccgcgcccggcccacagcatcatttttcaagggtctctagggtgaccaggtgtccgggtttgccaaggacagtcccagtttctacctgctgtcctaggacaatcatgaatagtgcccctttcagtttcaaaagtgtcatagtttagacattaaattacctgaccacccttatatgccccatgtttcttaacatctaggctgctgacaaaattcacattttctgactgtcagtctagtgttctctatactagactgatacggatccacaaaggaagcaatattggccaacaattaatcttcagtctttggattagtgagaggtgacaacgtgctggcagccgtcacagccctcgctcactctccccgcctcctctgcctggtttcccagtttgacggcacttgaggagcccttcagcccgccgctgcactgtgggagccccttcctgggctggccgaggccggaggcggctcccccagcttgcggggaggtgtggagggagaggcgagggcggga

SEQ ID NO: 3187 - DNA, 534 bp, Homo sapiens
aaaaaagaaagaaaaagaggttcactgaaccctcagttttcccaatcacttaggataaggacaggaggaattaacgatgaatggcagaaatgtgagtacttaataatgtaatgatataatctcatcatagctaatagtttttgagcatgtattatgctagtagatttatatcatttaattttcacaactctttgtggatgctattattaaccttgttttacagatgagaaaactgaggcccagaaaagttgagcaacttgcctgaggttacacagatactgagtggcagagctgatatttgaacctatacattatgtctccttagcctatatccttaaccactggattatccaaaacactatggcagtatttcagtcaggacatcagatttaaaatcatagtgagagaccggtaaacacacatgagaatggctaaaatgaagaagattgacaataccaagtttgaggaggatatggagcaactgggactctcatgcatagctggtgagagtgtaaatacatgtaaccactattg

SEQ ID NO: 3188 - DNA, 3647 bp, Homo sapiens
cgtgattactcttgctagcacttctaatagtatgttgaataggaatgaggagagtggacatccttgtcttattccaagaggaatactttcagcttttccctgttcataatgatgttggctgtgggtttgtcttagatggcttgttattttgaggtatgttccttcaatgcctagtttgctgaggatttttatcataaagggatgttgtattttattgaaagcttttttgtgtctattgagacaatcttatggtttttgtttttagttccatttatatggtgaaccacatgtattgatttccataagtgtaaccaatcttgcatcccaggaataatgcctatttggttatgatgaattaaattcttgggccaggtgcagtggctcatgcctgtaatcccatcactttgggaggtggaggtgggtggatcacctgaggtcgggagttcaagaccagcctgaccaacatggagaaaccctgtctctactaaaaatacaaaattagtcgggcatggtggtgggtgcctgtaatcccagctactcagggggctgaggcaggagcatctcttgaacccaggaggcaggggttgtggtgagctgagatcacatcattgcactccagcctgggcaacaagagtgaaactccgtctcaaaaaaaaaaaaaaattgatgtgttgctggactcaatttactagtgttttcttgaaaatgtttgcatctatattcatcagggatattggcctgtagtgttcttttattgttgtgtctttgcagaacccacagaagacttccatgaagctcttgcaatataaaagacccagaactcagccccacttctggaaccttgctttcagaccttgcattctgttgcaccagtggacaccgcacagaccagcaatctggctcagccaattctgtgattccacccagcaacacaagacagcaggcaaggtccagctctgtcacccacactggacttcggtggtacaatcctagctcactgcggcctcgaacttctgggctcaagtgatcctccaggtaaataaagaacttggcatataaaacaggtttattgaaagaggaaaaggtgaactaataaaaaagaagcataaaggtaagtatttacagaaactctgtttacatttaggagtcataattctttttataattaaaacaatttacaatcacaaaactgagattagaagtgcttacatatttcacgtgtaataagtgtttattatttatgaagaaaagtcttgatatgtgtaacattacattcactcattagaaattgactatgtgtttaagtttccaaataatacattttcttttcacaaagtcattttcctaaatgaaaatctgagtgctagcctagaatacaagagtgcatagtttaaaaataaagataaatcattattgtttaaaaatcaatttgaaatttctgggggaaattgaatcattgctgcaattcatatctatcaaaaattgctggtttctccagaaggaaaaacaaaactgacagatttgaaggcgatctctgtataggaatactcaattacattcttctgctcactgcggttaatcatattttaaattgtcatttaaaatcttgtaattctgataaccttatgatatttaggcacatataggttaaacattaacatacaagaaatataatattcactgttcttataaagtacacaaattttattcttgaaaattgtatttgaaattagtaaatttatgttatatattcagttcttatgctagttaatttctgtcaaaagttcaggagtttttgatacaatgaaaagttagtattttaaaaatatatgtatgctagatatcacaggctataatattaagaactgtagttgaatatgaatttagaattttcgttacaacacatcacccagtacattccagttttggtcaaagcgcattgaaaatctgtgaccacattttttttaaatatagaagattttgaaagcacttaaaggaaagctaaacaaagggtatgtggctagtggatgtgatttttaaagcgttgttagaagaacatatcattgatttagactttgcttggtgtctgggccattaagaatcatggattacattccatgggacctgtgtaaactaacagcatcttatggaaatgcttttattcctgtcaatatcgcatgttaaaactaaaatattattacagggatactcaatctaaaaaatgcttagaaaacaaaacaagtttggttatcacctcacaatcgacagagtctacctgttatattcatagtgagggacagagtgaagagtcataggtttccacaacttaaaaaatctatttcaaactaggcattatttacagtcaaagacttagagactggtacctgactctgagatgactgcccttaacataaaaaaatagagttctcttatcctctgggaataatacataaatcctaccacatacaggaggataacactaaggtttacgtttcttattatgatattgattcaaagttgataagcaagaatctttttgaagagcctgttaggatagctttgttcatatggtttcaaacaatcccggtgggaattgtccctgtcaagatacagggctctggaagccaagtcaattactttattggaaactcaatatagtatgctatctaatgctgttagggagaaacactacctgtggttttccagtttttgtgatggtgaaagatgagcaaaagaggagagagataagtcagaatatagctgcagccatatttctaaatatatccctgccaagcacagagcagcaggcaaggcccatgccaaggcctgtcagacagatttagccagtaaaatacggcaagccccttttagattcaaacattttattacttggccagaaaaaggaagaacagcaaaaggagacaatgcactgagctctttgtcccccacactcaaaagtgtaaaactcagacaaaaagggctagttgacaatgcagtgaaagggacactgtgttcttgaggactcaatgccagaaggttgttacatatgtttatagactgcagctttaacctaaggggcacggagcagaaagcctcttcccttatcagaacctgggaaataatgagaaacggaggcatgactgcctcccatgtgatataagaaggtgagtaaatatgacctcatggcattttctcatatccttttatgagaaggcttttgtcttccagaaagcccgtaagttgttccaccaaggctcagattagctgtggttcaaacttttgcctacatggcctatatggacacaggcaaagtcaccagaatgccatgatgcaattgtccccctataataccgatgaagtctaaatttccaattgtatactatgtgtcttgagcgtgattttctttctcctttttttgtgatgtttcgtttattcctcactcatcaacacacatgcatgcacatgcattcacacacacagatatatgagaacaaaaaataataaaattgcttgtaaaatacttactaaaattaccatggtgccagtaacaatttttcccaggtagatgaatatatgtaactttacaaccctcaagcttgtgaatcggggcaattataattacattaatataaagaaatttgaaggtc

SEQ ID NO: 3189 - DNA, 720 bp, Homo sapiens
cactgactgaaatgttattatgtgctgcatgaacgcatctgttaaatgtataaactaaagagttgaaacaaatcccatgtttggccaatgtagaatctaagtagaaggaagacatagaactaaatttttcatccttttataactacaaatggatttaaatataatattaagtcttctgttcacatagtacatggttcaaatgtacatagaaagtacatataaatatctggaggaagattattccaggtggagagaactgcaagaccttgtggcaagaaggggctcagcatgactgacaaatagcaagaaggatgtcagctgtggcactggctaccttgacacatcttcatctgaagaaaaaatacaaagaaggcctgccatgatgacaatttacttcatgaagagaacgggttctgaaacggtcattcttttccatttaaacaatgttaccatctcccaaagaacagctttggggtaggaaagaacagtatttcatttcaagctggactactcatctaccaaaaaaccattctgaccaaagaaacagatgcagaattacagtcacagctgcattctgcacagaacaagttggataatgctatactgcattcagttttcttggataaataaatacctagaagtagaggtgctagatcattgggtaggtgtatatttatttaatttcataagaaactgccaaaatgtctagcaacatgttat

SEQ ID NO: 3190 - DNA, 2777 bp, Homo sapiens
ggagtgtcccggggagagtgggtccttgagctcctctgggccttgcttgggacttggtccaggaggttatgggaagaaactggtttagaagctgacctcatgggttcgctattcttatgtaacacttaggaagagcagagacccacgcgattcagtcccagagcaatgttgcggtcaagagaacacagtccagctaccaacagttatttcaaaataattcaagctctttgtttatatttctgaaagaaagaaagaaaaaaaaagggtggcccagctggaaactcggctttaagtcccctttcagggggccctcagccgtacagaatccacctggcaaaaatggaaactgcctggaggccagggctgagggaaggcctggagcagagccggtgcgcgacctcgcagtgagcagggagggcaggctggggacgttcaccacccagaacgcctctgctccccgcaaccctgagactccaggctcccctgttcctccctccgggagaccctgcccgtcctccccgcggggctccttcgcagttcgggggaagggacgggttgcgtcctcgggacctttctctgcagccacagcagcgcatcccagcacctcctccaggagccccgccacctcctgccacccggactttccccacagcgcagcgtcccctcgtcctctcagggctggaacagcggtacccgcagacagtgcaaaagggaagtccctgttgccttcccatgcaaactgtagggcgcttacagctgctgggagaggaaaggaaagaagaaatacaagcctgtgacccggatccaacccgcggcgcacagaccccggctctgggcacccctggtgagcgccttctgcgccagagctccgtacagcaccagcccgcgctctcccccagcttctgttcatttgctgcagtcctgacgggtcagttgcctgagcatccatgctgccatccatacaaacccaggcacgcagagatgtacatcctttacccagggtgacaccatgtggagctgaatccaagtccgggagtctgatgaccgtgtctgggctctgaccgcgcagccgtctcacagtgaaacaaattgcggactggccttgtcctgagtggccttaggaagctgcagtggcctgcagtctcctggccagtctgtagaatttggcaaagatgaggcaccttatagccttacatgttcttatttttctttccttttctcttctttattttcttttttaaggatttgaattagtatatgtaaagtgcttaacgcaggagctggcagagaaagtggatactcagtaaataacagcaattgttaattgtaaaaagcatgccacttatctggtaaaatcccccattctaagcaccctgttaagtagttggtaattcctcacttgaaagaaattaaaaagaatttttgtcagttttttaaaatattgttttattgtgataaaatattcataacataaatttcactcttttaatactttttaagtgtacaatgcagattaataagagaaatgcatacaaatttattaacgtgtacacgggaaaaataaggtgattacccaatatcccatgaggtccagatacttatacagcgttttttcagagaggagggtggaaggcggaatgtaggtgattctgttgaggggcaataaattattattaaggagaatgaatgggtcaagaaacagagagttattcgtaaatggttctctttgaaaatttaataagctggagaaatggattatttttttgaaagcgtctgttcaggtgtggtcacgtgttggttttcttttctgcaatagataatgagataagagggaggagaaggaaaagtaattgttctctttggtgggtctgcagggtcttcatgtagataagggagaggactcttccagcttctgttgatcttgagggactttaattgaaaatactcataccagggagccatattttggggccaagttccctgcgctccttcaatcctcctgtttggaacttccctagaatttcacattatcaacagctgaatcagtgattatggagagatttgggttagaggaaaagaaggcaaagaaggggaaaaaacaaattgggataagcagaaaagaaaaataaataaatatgttgtcccatatcttcttgaatcagtctcttagtcctaagagtagaagcatttggtcaaacagctgtgtccattctaggaggtggcactacagaggggctgggcttctacagctgatgcaggcaagctggtctttaataagaggcatttctatggaaacaaagaaaaacaaaggtttttcttaatgtctggaatagtccataataaactagtttttctagagtctcagaagtatcttcagattgtagtggtaatcttacagattttcctggattatagtttgaattacgtgttcatgtgaacttcctgagtagcccatacatcagcaggcacaaaggctgtgtacatgtgagttgctgtgctgactcctcctgaagtttatatcaagttgtctaactttagtttgcagggcttcaagaaaagcagttttaaattctagtgattccaagtgagaaaaatgagagaaaagttcaaaagcattagtttgaagacttgcagccaagaaagaattcaggatttagtccaaattgtaggaaaataataaaaactcaaaaacaatgggcaagactagaatctgataacaggcatactgtacttgtcttctgaaatgcaatttttctctcccgtttccccgtttttac

SEQ ID NO: 3191 - DNA, 3139 bp, Homo sapiens
aaactttatatcgtgtgaatgaaaagtttaaacattttagacttgcttatgattttgttgtgaagaaatatgatgggttttaataagagcaaatatatgcaacacactaaacttcaatgatctcagtaagtgcaactgagcaagataagaatctagtttctttttctcactctgctccaatctttcagtcaacactgactgcctcctttctataatttgagaatttacaagaaaatagtatgtgggaccttcagtgaactgagcttatgtgattcaataagcctcattcaccctaaatctaattttaccagttaagttcttgataataggcccgtgttccaagacattcttgaaagcactgaggaaatcttttgataatattatctctggtatacttattccatattggatttattttcatttaatgtcacactatcacttataatcctttcaacaagagagagtagttatgtctgactctagactgtgctttgcaaataaaatttcgtaagtatggaaggaggtgccttattcccaaacccaaataaatggagagctatgctaaatgaacactgacacattatttggagttgggatagaatgttctgttacataacaatgacataaatgcaaaaatgatggaggtgctcaaatatctgcatgtagaggatttggaaaggaaggtgatatagtttggatttgtgttctctctaaatttcatgttgaattgtaattcccaatgtttgagatggggcctggtgggaggtgattggatcatgggggagaatccctcatagcttggtgctgtcttcacaatggtgagtaagttctctcaagacctgattgtttaagagagtgtggcccctgtcccctacaactatttctcttgctcctgccatgtgagacacctgttcccccttcatcttctgccatgattggaagcttcctgagacctccccagaagcagatgccagctctatgcttcttgtgcaagctacagaaccgtgagccaatgaaaccacttttctttaaataaattacttagtcttaggtacttctttatagcaatacaagaatggcctagtacagaaaattggtactgaggaggggggaactgttataaagttacttgaaatgtggaagcagctttggaactgggtaacaagcagaggttggaagagtttggagggctcagaagaagacgagaagatgatggaaaatttagaatttattagagactggttaaatggtcatgatcaaaatgctgatagtgatatggacaatgaagtccaggctgaggaggtctcagatggcaatgaggatcttaccggaaactggagcaaaggtcatgcatgttatgccttagcaaagagcctggctgtactatgcccctgccctagggacctgtggtagtttgaatttcagagtgatgatttagagtatctggcagaagaaatttctaagcagcaaagtgttcaagatggggcctggctgcttctgacaacctacacttatatgtaaaagcaaagaaatgacttcaagttggaagttctatttaaaagggaagcagagaaaaaaagtttggaaaatttccagcctagccatgtgatagggaatgaaaaagcttttgtgggagaggaattcaagcaagctgtggagcaaccatttactagagatacttggaaaagggagccaagtgctaatatcccagacaatgggggaaaggcctcaaaggcatttcgaggccttcagggcaatccctcccatcacaggcctagaggcctaggaggatggttttgtgggcttggccaagggctccactgctaggtgcagcctcaggacactgctgtctgcatcctggcagctctggctccagactcagctcaaagggtcttagatacagctagggctgctgcctcagaagatacaagctataaaacttggcagcttccatgtgtggttaaccttgtaggcacagagagtgcaagagtgaatgaggcttggcagcctccacctagatttcagagggtgtgcaagaaagcctgggtagccaggcagaagcctgcttcaggggcagagtcctcacagagaacctctactagggcaatgtggagagaaaatgtggctttggagcccccacacagagtccccactggggcactgacgggtggagctgtgaggagggacccaccatcctccagatcccagaatggtagagccactggcagcttgaaccctgtgcctggaaaaaccacaggctctcagttccaacctgtgagagcagctacttgggctgcaccctaaacatccacagggcattgggagtctaccccttgctccattgtgccttccatgtgggacatggagtcaaaggatataattttggagctttaagatttaaagactgccctgctgggttctggactttcatggagcatgtagccccctttttcggctgatttttcccttttggagtgagaatgtttacctaatgcttgtacccccattgtgtcttagaagtaagtaacttgttttttattttataggctcataaggggaagggacttgccttgtctcggatgagactttggactttgaatttctgagttaatgctgaaatgtcttaagactttgggggactgttgggaagggacacttgtattttgcagtgtgagaagaaactgaggcttgagggcaaggggcagaattgatatagtttggatatgtgtcccctctaaatctcttgttgtattgtaatctccagtgttggaggtgggacctggtaggaggtgattggctcatgggggaggatcttcatgatgatgctatggaagatcagaaaatataaatttatgaactgctataaactgttattttcttcgtgaagatcagcacaacaagatgttccagacttattcaacatattgtccagccagtcctggaaacaatcagttccctgaggacagaattaaagtttagagacctgaatctgggccccaggggtggtcattactactggtttgccactgcttctgtagcttttcagtgaagaggtagttatgtaatatgtatctaaaaaaataaattcaagttatgtattttaaaaataaattcaaggtctatatattttagaaaaagg

SEQ ID NO: 3192 - DNA, 1672 bp, Homo sapiens
agcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattgg

SEQ ID NO: 3193 - DNA, 2847 bp, Homo sapiens
ccgctgcctacgctgccacgccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaat

SEQ ID NO: 3194 - DNA, 382 bp, Homo sapiens
ggggactaagagtccatgcccagggaatggtttctctctcttccgctggactttaacaagcaagcacatgacgggcttcatcagtcctggacgagaaagctgagatgaaaataacttgagtcttggatgaaatcagtgaccctatgatatcatcacatctagagctgactctaactggacttccagctatttccaggacatattcaagcagagtttggataaccacctgccaaagatctgtattgggtgggaagttggttcatacctgtcttaattgtccaagattctattcttcacctagattatctctgtaaatcatgaagtgcttactaaaagtattatatccaaatgaatattcaagtaaaaatataaacaataaaat

SEQ ID NO: 3195 - DNA, 12307 bp, Homo sapiens
aggttcaagtgcgcatgtgcgcgaggagtcgctcgggcacttattgagcgccgactgtctacgggcggccggggacagtcttgcactgtttcctaggctggagtgcagtggcacaatcacagctcactgcagccttgacttccccaggctcaagccattctcctacctcagcctcccaagcagttgggaccacaggtaggtgccaccacacccggctaatttttaaattttttttagagacagggtctcactgtgttgctcagtctgatctcaaactcctggccttaagtgattctcccaccttggcctcccaaagtgctgggattacaggcatgagctacctgtgcacagccaattttgtatttctaaggactctataggtagtgctttgaggaggaggcagggggtgcgtgtctgtttaaaaagcagtaacctatgtggttaggagtccccagtgagtgaataataatgttttagagtttgtgcaatgggatgttcagattcttttttctcattagctcaggggatttggatttatattaggaatcctgattcccatctgaaagagtcaaaaccacagacagctaggcctggtatggaggaagtgtgattgggcaagggctggcttattagggaacgtgtgtgttgtgttggagtgctgcagtgctgggttggaagaactggaattactcctaggacatccctttggatgatcagaagtcccattgacatactttctcttttttccctgccttttccttgaactagcatataaatttaacaatccacagagttgcggagttgggcttgtaatattgaaacaagatctgtgctgcaaagcccactgctgactggaaacgcagatgtgcactgctgagctcacagcccctgggaagcatggcccagattcagggtgaaattgcccccaaacatattattgaaatgcattgaacagggactgtttcttttctttttaaaaaaaaaatttaaatgaaaatttcattgcgcaagttagtacacgaacacattctctggaggggaaaaatgcaaaacttctgcagcaatcagaaagttttccttgatgactgttcctaatcccagtcccttccccagaggtccagcactttcatggacttgctgttcttcagatgcctcacatactcacatctatacctataggacttacaaaaagttaagtgcattggctgtggattacgtaaggtctctttactgaattgcctctccctccctcaacagggtgcttggtgatagttcccggctcctatgcaaaggtctccttgattttgtttaacctctgcccggtctccctttgaattagaaggctacacaagtacttcacctttccctaattcatgggcacttcagtcatttccagatcctttactgttaaaaacgctgataccaaaaaacattgctgcacagacctctatagcacctgtgagttttctctggggtaggtactgagaaagtggaactgctgggccgtagggttcttgagttgtacattgtaacaaagatgcattatggggtcagttcctcacttagagttactgtgggacgggggatgcctgccctgtgctcagacattaagcagttatttgaagacaagggggcaggatttagagtgtgctaggtggatgctcaccggcctcacaggtcgcacataccattgctggtttgtgggaagggttggtattgggaagggctcttctgggcctcctagttaattctacctggttcccgccccccaacccctgaggactttgacccgtatgttgatagtggttgtgtggaaaagaatcacaggccgaacgggcagcccgttgtggactctggatgggaaattctaaactcagttcacttggcctggagaccgtcaccgcacctgcggttcttctccaggctgcctttgtaatccagtgtggcttaaacactcaagcaaagcgtgaggcgtttggaagcatgatgttctttaaaggcatctagaatgcggccacgtggctgttattagcagtttatgttaattacagaagaatggcatgtgccactgtttacgattctggccttcatctctatctctctatagaacttgtggaaaacatgagaattaatcctatcagatcaaacccatgcatttaggagccagtgtggcaagggagggagtggctgtgcccttcccgaagacagctttgtggccggttgtgggccggtgtccctggccacctgggtggggagaggcagaggcccctttgcagccttcacgattttacgtgcattcaacctcaaatctccatgcagtctgtaatgaagcagtgctagttggagcctagggcaaccccactcgtgcattcattcactgtccaaatgcagtgtgcacttcatttgccttcactggggtattccagcatcccctctttggtctccagctgatgttagtggggcctcccttttctgtcatttcaatatttggtgaccaagttggcattctactcctctctccaacttggcggattctcttggggccctcctggccttgatcctttgtcctgaagagcgctgccttcttagcttgccctccctgtcacacagcacatttaggttaatggtcctctggcctcataagtcatctttttttatccccgccggccctgagacagggtctcactctgttgttcaggctggaatgcatgggacaattacaactcactgcagcctcaacctcccaggctcaagtgatcctcccacctcagcctcctgagtagctgggactgcaggcacatgctaccacgcctggctgatgtttgtattttttgtagagatggggtctgcctgtgttgcccaggctggtcttgaactcctgagctcaagccatcctctgcctcggcctcccgaagtgctgggatgtgactgtttccatagagctcttgcatggttttcatttttttcttaccatctattacactgcccttgttgatgttaaaatttactgtatttcccccgcatttgcacaaactctttctgataattttccgataggtttggctcttcactgcccgggatttggtgtctactttttttcaggtcagcatttatcgcgcacttttgctaggcacagtgctcagtatccaacatgcattttctcactgtttcctctctcagacctgggggatcagaatctctaggaaggggagcttgggaactcttaacaaaatcaaggcacttctggaaaaaaaaattcattgcctcattaaagccccaaattatcctctgggataggatcaatactttttctcattttgcacgtgaggaaactgaggcacagagtggtgaggtcatttggccaaagtcacaatggggaagtttgagcttttttttaaaactatttttttttttgagatagggtctcactctgtcacccaggctagagtgcagtggcatgattttgactcactgcaacctcctaggtacaagcaattctcatacctcagcctccccagtagctgggattgcaggtgcccaccatcatgtccaggtaacttttgtatttttagtagagatgaggttttgctatgttggtcaggctggtcttgaactcctcaccttaagtgatccacctgccttggcctcccaaagtgctgggattacaggcgtgagtcactgcgcccagccggaagtctgagcttaaggcagccctgactgtttgtgcattctctttgggatatttgtaaagggtgaaataagaagaattgtcgccctgctcctgggggatcccatgcttgattctttgctgtcataatgcacatttcccgttccatgccacaaccactaataccacattagcctcttggtgactcaagtttttaaaaacaaggaagcttatgtggtcatctagtttggtctgtcacttgatgcatacatttcctggctgtacaacatagtagaaagagcatagcttgtctgggtctggtggctcacacctgtaatcctagcactttagaaggccgaggcaggaggatcgattgagcccaggaattcgagaaaagccttggcaacatggtgaaatcctgtctctacaaaaaatacaaaaatgagtcagatgtggtggcacgcacctgtagtcgcagctatttgggaggttgaggtggcaggatagcttgaacctgggaggtcaaggccgcagtgagctgtgatcgtgcgactgcactccagcctgggtggcagagggagaccctgtctcaaaacaaacaaacatagcttttgaaatcagacacatttgggctcacattctgagttctgtcattttctagcttcgtggccttgggaaaattactcaccctgagattcagtttgctcatctgtaaaatgggaatgatgatggtatttataatctcatgggttatttgtgggggattaaatgagacacagtctgcgaaatgctcagcaagttgactggcacttaagtctttgataaatgatagctgttagaacattcctgaatgcacatcagtctttgaaaggccacggattacatataagggttcctgttattctcttgtcacttagatgtgattttatttcttgggaacatcctactgccttttcttcaaaagattctcctcttctgctggccttgaactaagtccagtctacctgctggcctgaggtggcgggggtgtgtgtgtcagccccctcagttgtgttcctggggcaggcagaactcaccagcacccggtgctgattttatcccttccttctctgaaaactcggagagtatgtgccagctgctgtctgcgattgatgcacatttattttgtcacttgggctcagaacgtcctcaccagtgagcagcttctgattaatgccgccaccccatccatttcaagaaaagcttcagagagtggcaccccaacatcctaagctgggactggggtgaactctcattcagcctgtttctccatctctctttcgtctcgaaactcattctcatgcccacagttattggggcataaagattccttaaatggcttcctccagagaaaaatacgtttaaggcacttccttagtggtttgagccctgggcgagcccctcctccactccgtttattttccactatgtatttaaatcttccccgatggtgcctgtcttctcgtcactaaggctgactttctgtttttggggtgaaacctgtgtctccttcaacctccagtcactcagtggattttttttttttagattcataacatattttattttgacttatctaactgatgtcaaaaatggaaaatgttcacatggatattcatctaactcatgggctccattctaaaaaccccctttttaaaaatcaggcttcagtgtcagattgctgaatgtttttttcattttcctgagagatgcaaatgttcattcattcatctcattatacaacacagtacataaatgtagcttcagagcgtattaagtgcttttatacacaagtgctggctgtgtggaccaggtggtagctcatttaggccccaaattcattaagggcagggtctgactcttaggcttcttaatatttggtttggtgcatggtcaagagctggacccacatgttgcatagcagcagggctgatatgtttaaagacgctgggctttttctgctctggggccctttcccgggggttccggtgagtccctccccaggtgggtctgcccccacccgtgtgggcgggattagctcccagaggctggccaggccccacctgggggaggcttgagggcagggccccaaggctgagattcaggcttgggggaacagagcaggaaagagacccggtaccgaaagtgagcggggcaggcacctagtcacatgggtaatgggcaggggtcggtcactggctttggctccagggccagagcagtctgacttagtgttgagctccaagcatggaacactggagttggttcattttgaccagcaagcctctaaatgggtgccttgattacccaccgcaaggagagggcagttgcctttttatgacatgttaattccagccaggtgagtcaccaggtagctctcatcctcctgccaggctcccctgcctgtcggtttggcattgtcagataatgtgatcattcattgaagtgacatttgagttccaaaccagttttctcctttaaccatttcaccctcaggagtgattctcctttgtttggcattgtcagggaatgtgatgatccattcaaatgacttttgagttccaaatagtgtttctactttaacttcctaaatgaaaaaaaaaaaaaaaaaaattggccaggcacagtggctcatgcctgtaatcccagcactttgggaggccgaggtgggcagatcacttgaagccaggagttcgagaccagcctggccaacttggtgaaaccccatctctaccaaaaaggcaaaaattagcccggcatggtggcaggcacctgtaatcccagctacttgggaggctgaggcaggagaattgcttggacctgggaagaggaggctgcagtgagccgagatggcgccactgcaccccaacctggtcgacagagcgagactctatctcaaaaaaaaagagaaagaaaagaaagtagagtccatgttcctgtgttcctctgctttcttcaaggagcgagaatgtaggaaccctttttgtcctcttgggattggcacctggggcgttgttaggcttttaaaactctcacgtctgtgttttatatttttggaatggcagcttttttttttttttttaattggcagcttttgcttgttgttactgcaagtgcttccagtaaatcccttctccatgaaactcactctcttcctctggatccccccaactcaccctccccaggcctgagccgcgccttgctgctgggtctccacttgtggggaagagagaactggaccaggacagcgcgggaaactgacaatgccactgcttgctagctttgggattttggacaaataggtgacctttttgaacctgtgttctcagctctaaaatggggataatgttgttccttcatattttattgagttgctgggaagttgggaaagaagagaagcccccagcgtgtgcattcaagagagtataaacctgagtgccattcaagcatttgtgggtgctttgaggtcctgtgcaggtctcttagaagtttaccctgaagactgctagaattgctagttctgtgaggcttgttctccccagggatactcggctcctggttccctccctccagtcctggctctgggtaaaatgccaagtcagcaatcatccatctccccacctccttctggaactgtcatgtggtttgagaacagtttaaatcaggtttaaccacactgcacgctgcccctgccccaccacatacatgcacgccccagcgccccatgcatttacaaaaacactgcaggacaactgcgtcccctcacccagacatctgtcagcatagtcctgcttatacctgcttccttctgtctacctgtttttaaggaaaccctgtcttggaagcaagttcgaatgctcttgatacttttgccttcattttagggccagcagcaggtattctttcttataacacgtttttcttgaatctgggcctcttcttaccgctggaagatcagctgtttaagatcagtctaaggaggctgcagtcccatcggtgccagtagagagggttgtggattcctgagccctcactatgtgccaaggagtgtcctaagagctgtcttgtgtaatagggtagtgtgaactccagagagtcgtgaacaaaggcactgcgtttctgagagcaaatggggaggtaggtgtgaaggaaggggaagtgtattttttcctgggtagagctgtggaaacgctttcctgccagcagcgcaaacagaaacagtctcttttacttgattgaatgactgttgtgcagtcagaccagcaggaatatttgttgatcaggatcgtttattatttgctggagagaatttgctgtaagcagatcagatgacctatttttatggcccatctgctggaatatgaaaatagtagtgttagttgggagtcccttcttcctcctttccattactgtattacatctattacttagagtaataggaaggctggatgctcagttatagggtatgccatcaagaaaataccagccctgaatgggagttggacaattattctggtccctatcagtcttgatattctatcattttaattttactggtagtctaaactattctacactgatgcagtgtagtccagttttttaaaaccttcagaaaaagacaataattagaatgccctgagaatccacattgtcacactctgaccagctgattgagaacttgaatcaatcaccaatatgctcagtgccatgtgtctgaagcttgtactgtgaaaatcctaagtacacaccacacccctcttaaaaatagggtaacaggacctggtaattccagagagctagaagttttaagtcacggcttttgatgctcttgctaaggccctggctttctattgaaagccaggaggagttttctcctatttcttcaaagaaaaggtccatgtatgcttagcgaagtgtcttttttttttttttttttaaactttctttggggaagacataccaggaaaaaaaaggcttgagaaccagccaccaggtagcagttgggtatgggatgggacagtttgcttctgccaaggttcaaatggtgacctgcaaaccaggaggaccataaacatatttgcatatacttacaaatatgcttgcaagtactcatggcatttgtcagcagagatgttggctaagaattgctgaaaatgaattctttgggaatcttgttctccatggagttccattgtgaaataagagatgcaaacattcactgcaaacattttggcctttgattatttatttatttagagctcagacgatcctcctgcctcagcctcctgagtagtggaactataggcgtgtaccactatgccctgcaagtttagaacatcacactgaaaaacttaagtaaaaatgttatagatttaaaggaaaaattggcacttttctgataaaagataaagaatgatatggttaaatattaaccaaacacctaaaaacttaaactgttgttcctgcagtgatacccggtggagataataaaatatacagagagctgagtttagcagagaactgaagctcttggcaggagggtttatatccctcagttgacctataaattattcattagagaagtagcaagcacccacgcttttgcaaataggagtcttactccaaacttcacccttcttaagttaaaataaaccccacgagttgtgcagtgaatcactttgacttatgacttgtgttctggaagtgctgctaggtgatatcatagctcgctgcagtgtccctgggtggtaggagagcacagccaccgtgcgtgtgtgtgtgcacgcacacaagtgtgggggcgtgcctacgtgtgctgagacatgtggttgtccagcaacagttacatgacaaatagcagtttgcaaccccgaaccacagagagagtttgttttactgttctgcctgttccagttccttaactgatggcagatgtcctcattaagggctattagcacatcagaatgtgtttgctgagcccagaaaagaactaactccttttggacatggactgaaagatgttatctagggtagccaacccctcctgttggtgacggcagtagggagtgaggaacacaagagggcttggtatccccttaaaactttcctgagaagccttcagcacgagtttgtttcagtcagggaattccataagaggagaatgtaaaatcataaagtgggatttggctgtgtgttgaactactgttattgttacccggaaataggtgtttcttgatttctcttggctgctccagaaccatatggcaaactaggggatggctggtttatagggaccattgatagctcccaagaaagaacttaccagaggagtgaatgaagtggagattctggaggagagaggttggaaggaggccaccgctggaatggtggaagtgcaccaggtgggcaggacccccggagtgattatgaggcagcaggaggtcctgaaaagtcacgggcggcccagagttaaccttgctccttgacccacctgttggcagacctttgctgatgctgtcattcgctctgagtccccaaagacccttggttacttgtgctgtctatcgagttgcatctgtaaatgtcatgagtgtgctgattaacacaggcgaggcatcgagtgatgcctggtgatgctgcccagcctggattagtctagatttgtatttctcccacttccatcctattaatccccagtataaacttggctaaagttttccctgactttttgggttgattccattatccctttgcgtgccctgccagagggcaatatgtgtataaaggtcttccccaaacctgaactgctaaatgattaacagtggcttgggctgcttaacagggtcagattaaagcgttgacctttatcctgtaggtaagaggccaagatccaagtggagaagagattttttcaaggaatgaaagtacgtgagaaaatggatgtgtagacttttagatcaggagctattttttctttttatctttttgagatggaatctccgcctgtctcccaggctggagtgcagtggtgtgatcttggctcactgcaacctctgcctcctgggttcaagtgattctttttttttttttttttttttgagacggagtctcactctatcccccaggctggactgcagtggtgcgatctcagctcactgcaacctctgcctcccgggttcaagcgattcttgtgcttcagcctcccaagtagctgcgcttacaagtgcacgccaccacacctggctaatttttgatatttttagtagagatagggtttcaccatgttagccaggctggtcttgaacctcccgacctcaagtgatctgcctgccttggcctcccaaagtgtttgggattacaggcgtgagccactgcacctgtccaggagctatttttcccatcaaggttcactaacatagggaaaaaaacaccaagttgatgaaaatcaacttaattgagtgttttattttgagagatcccacacctactagaatcatggcaggattgtgacctctgacaccagacagacgtgagttcatactcaaggctgcagttcctagttgtgcagctttggcatcctgacctctctgaggttgtcacctcatcagaaatagaagaccattggttcatctcagatccttttgaggattaaattagatacaatttatgaaagctagtacctcttaggcacttaataaagacagtttcccttccttctttctcttctgcttttaaaaattaagatttgggagtactataaataaagccaatgagaaaatgtattttggtgtggaattctggccagttaaaggagaaaggggacaggagggctccagtcagaagtggcaggttcaccagctccatgcgaatccggcaggcctggaaggttgcaggcacaaacaaaataggcagtagaaagcagtctttaaattaaaaaaaagaataaggcttacaaaaaacatcgaccgagtttgttggccaaacatttcaggcgccgtctgaagactgggagcccaggaatttgggaaatactaccctttcttcattttcagtggtagaaaccccaaacttcctgctctagaacgtggggaggccattagttttgttttgttttgttttgttttttggccaagaaaagtggtgcagtttctttctctgggttgatgctgccatctcatgtctctacatggcattgcgacttcacctctggatcctatcagcccagtgaaattgaactgagagttagaggtgctccattttagcctgaggctccaaagacgaaggtatgtaggtgacagtgttttaaaaaacagtttaaggccaggcacggtgcctcatgcctgtaatcccagcatctgcctgcctgctgaggcaggcagatggcctgagctcaggagtttgagaccaccctgggcaacatgatgaaaacctgtctctactaaaatacaaaatattagccaggcgtggtagcgcacacctgtggttccagctacttgggaggctgaggtaggagaattgcttgaacccaggaggcagaggttgcagtgagctgagatcacgccactgcactccagcctgggcaacaaagtgagactccatctt

SEQ ID NO: 3196 - DNA, 4815 bp, Homo sapiens
gtctaacctcagctcatgattcccagaagcttccaaactgattgaaagtggcctgttcaacatttaatgaaattcacatttctgagactcattagtttggatctctggctttgcctgatgggttaaatcagaacattttatgttagttaactattgctggcaaagaggagagaaagaggtaggataatacactaaactaaacagcagaattcaaagtgatttcaggagtaacggatcaatgggaacccagtgaaccaaacctggatttgaatctcctacagacctaaagattccccatgctgcacataaccgaggctgggctggggttaacagtagtctccttggcttgaacctccacatcactaacattctttccacagttgttcatcaccacttctatgtccttctatagatatgttcctaatgttggactttaggaactgcagtggcagacagcaacttttattttccccagccaccatagccccactcaatatgacatttagacagatgagccagcaatacagtagttacatgtgtctgggatttgttttttaaattatatgtaccgcttttaatagcctgattacagctgttcagtaagtgatgcctctagactgaagaggaccgaaatgagaagcaggccagctaagagggctgggagcagcacgttccccttgttattgccagctagtggggagagaacatatggccactttacaaagttaagaatcacaaacagcagacaagaatgaatgattaatgctggagttcctggagtatgggccaaagaagttcccccaaaccttacaaacagaaacacatgcctctgccagtccccacatgggatcccagatgagaaacctctcaaggagaataacaaaatgcagttggaatcaaagtgtatgaagcctcccagacacacccagcaggagtcaccaggaagcagctgggaagaggctgacagcccaccagcaatgagaccacaggagctgctgctcccgggagggagtctgctgtcatcctccacttgctagagttctccctcctctctgcttgttacacactgcttccctgctctagagcttgctccagagatgacttcaacagaacagagtggctcttccttacttgaaacacagatccattgtacctgtggctttggctctggattgtctttctacttagaggagaacaagggtgtgactgagccacatgatggaaagtaaaggtacaaccaaaaattgtggcgtttcctcttgtttatgacattaaatttccctcagcctctaccctcatgctgcctgcttctctaaggctgctcccagggaacaagttaataatctcaaatacagtaatttttgcccctttcagaggtaagagtttaacaggggacaaaggacgaattttccatcatggcatttcaaacatcagtaaaatgttgattatttttcagcactcttgatattatatctgagtagctcttgtagaaattaatgcaagctgtgttttcactgcaatgtgcccttactgtattcacatgcagcgagaggttatgctgatggaacttggccatgatttgtgatattgtttatttacatgtattaatataaaataaaatgcaacgtgctaagtaacatttaagccctcattaacctgttcctgaactatttttccaactccattgatccctactccttgtgattcagccagtacctcaactgtttgtttctatgcttgttcaaggtttgtaatccttagtcctttgctcaaaatgagagtcagcctggcataagggaaaaagcactcaactcagacgagcctgagtgggaaacatgacttaaataagttagcaacttatgcaatatcatttatataactttgagcctttagcataatcatctgtaaaatgaagcttcccactgtgggatgttcttgaaaagggtgttataggatatggaagcactatgcacagatgaggctctcagtaaagttgttccatcatctctgagtacgcaaattttattcatcctttaagttgcagcccagatagcaccttttgcataaagtgtctactgattgcctccactgggatgcaatctttccctcttctcaactcctatctctctttgcctttatcaatcatatagtaagtgcgtctttttattttgtatcacagggtctcaaactgagactctgaatgtggcttgtgcagagtgcttcctgggattctgtgtgtatgggttactctgcatggagcctcctgttgccaaccaaaaaaggactaagcttggctcctttccaattctctgtacataattttgtattcatattatgttctttttcttgaagaaggccctgattttataggtgtcagtccccccaaatcctgattagcacctggggaggagggagatgagggtatggaactactggcatggtgtctgtccatatccgcagagctgaaggagttgtatggatgaaagacataatggtattggaaacaagtgtgctctttggggtctggataacaaagtatggcaaaagttgaggagttgagggaatatctgcaatccaaaagttgaggattagcaatgacagaaccacaatatccacaataccctggacatgcaattggcattctcttcatggatgctaacatcagtagcaacttctcatcaagtcaaatgcctcctcttcagagagtcttgctcactttttgtaacccctttcaccaacctctgtgtcatctaccctatttgtcacttttttttaagaggcaggatcttgctcttgctctatcacccaggctggagtgcagtggtgcaattataactcactgtagcctcaacttctgggcttaagtagtactctcacctccaccttctgagtagctaagactacaggcatgtatcactatgcctgctcccttatttgtcactatctgaaatcatctgatttgcctttccttaacccttcccccaaccacatatacacaaagtgccaagagtcaggggcttttcccaaagtgtttattacttacctctagaagaaaggggtgcctgtcttacaggaagtactcatgaagtatctgaggggtgagtaaatgtgaagactgttcaaggggctttataagaagaagacgaaaataaaggaagccaatatagaagaagaaaggcaggatcaatacctcatagtaacatgagctgacaacctggtttgtgaacatatggaaagcactccttaggatctcccagaaatgtttgatggggatgcttcctgtgtgcagttcctattagagcaggtgggatatttcagtcctcattggctagggagacctgggggcaattaggttatatgcatacttgagtttttttcatggatcttatcttctctattaaactcttaggagaaggtaggacaatcctcaaattgcccaaaggacctaatatatggtcttgcaaaagtgtctgttgataatataagtgtccatcaacagttgactggataaataaattgtgatgtgtatatatatatatatatatgtgtgtgtgtgtgtatatatatatatatgtatacacaccatggaatactatgcatccataaaaagcatgaaatcatgtcctttatagcaacatggatggagctggaggacattatcctaagtgaactaattcagaaacagtaaaccaaataccatatgttctcacttacaagtgggagctaagcaatgggtatacatggacataaaaataagataaatgacactggggactccagaagaagaaagggcaggaagggctaagggttgaaaaattacctattgagtacagtgttcgctaatgagtacactagaaacccaatccccaccagtatgcaatatacccatgtaataaagatgcacgtgtaccctctgaatctaaaacaaaataatttttaaaagtatgttgaaataaagaatgaatgaatcagagtagaagagaatatcttgttccatataaacagtctgtgttagaaaaagcaatataataaaccagaagtgttcagttgtgaaaagggttgaaatttttcaacataaatacgttacataaaagatttctattagaaactccttagaaggcatctattagaaggtagtgtcccttggctgtaaagtctaaaactctcctttgccacaaaatgacattgtacacaaatgtaaataagtataactggttacttagcaaccacaaatatttacaaatatggaagtcaggctccatcaaaatgtcagggtaattattggcaaattgtatatcatgcaaatgttttgcagccatgcaaaatgaacattcttgtagggtgctgccacaattgctcttcactgctgcctagaagtgtcacttagtctcttgggttttgttatgttgaattaatgggacataaaattattttacagaacaagtggatatgtaatttaccatatgcttttccacaggggtcttccacttagttgtcatggggtttaacctagttaaaatgctgcagaattcagcattatttactagatcatcttcctcaaaaaagtcaatatttttttttctaaaaaagacagggagactagaaattttgtggtttaaattttttttcaaaatttattcttttatgaattatatttgtagaaggaatcttttattacttacatttaacagtcttcagaactagtttcaaagattctcttaaggtatgcatgtgcttttttaaaaaaagaaagagagatggagagcaggaaagaacaaggaaggacagggaggggtagagaaagactgaagggaa

SEQ ID NO: 3197 - DNA, 572 bp, Homo sapiens
gaagaaaaatgtacaatcattgtgactgggctcactgtactctggtccttggctctcctaagactcataaaagccgctccagcggctaaggaagttctgtgcaaagcctgtagtttctagttgtgaagatcttcaggtttgcttgagcaatgaaagagtactggatttggagtccgcagtcctggatggccaccattaccagcaaaaggagtatttccggagcctggcacaacgctgggcacattgatggggctcaatgaatatgtattaaatgaacgagtgacagaacagattcgagacttggtgctgccatctactacagagaccttgatcgtgtcctttatctgccgtgaacctcagtttccatatctgtcaaccaggggtggttccctggggtagtgtgagagtaaattcccgccgcctgaggtgtgcagagttcccgcccttcccggagccgggcgccccaggagcgctctctctggctcccgccagaaaggatggctcctaggggtcagggccaggggtctgggaaggggtcgcgccgccagcagccagctccgggggaggcggcc

SEQ ID NO: 3198 - DNA, 1176 bp, Homo sapiens
tggggtctcctgagggtgcccccgccctcaggtaaggctacatgtgtgagaagcacgcagagcctgccattgtgtgtgtgtgtgtagcttggctgtggggctgagtgtgtgtgtagaagggaagtaaagcgtgagtatgggtgtgacaaaaattgtacttgtgtgcctgtgtccttggggtcacacaaggctgggaagacaggctaatgtccatgaaatgagtgtggccacatcacttggtgtgggcaccgatcactccccaaactcatttaaagccatagctgtcctggcaggtgtgagccatgctgggtctaggggtagggtgggagacaaagagagccacaagtcttgtcacttgcagatggcggaggggcgcccctccggcccttcctgacctaccctctctcccgctatggcggttgtcccaagcactcagtgatgggcacggggctgggcaccgccactctagggacatcagccaggggctggggtgtgagttgcaggaggggatgcagggctggagggggattagcaattccgagcactggctgcataattaaaaaatcattacggcaggcgggcagagctgagtgtgagctcacgcttagagcgggcggggacactgccatggcgctccccctcccactgcttccccgaggaaaaatcccacctgctaatataattatggaaaaacacaagcacagaaatttggtttcagcaaacaacgtgcctcagtgcccagggcctgcctggccctcagcacagcgagcaggctggccactggcatccagggctcatggcagtaaggcaggccctgctaggtccagacattacctccaccccctcagcaaccccccaagagaggagactgggaggggtatacaaagcccagctccctaaatcccaaattcaggagaaaatgggctggtgctgatggtttacaaacggggaaaccgaggctaaggactctacataaggtcactgtgtttgtggcaaagccaagaggaactggatccgtgctcagtgcaacacctcagggctcaacatcccctcccgactccccctatcagtcatcccccagccttctccgctccgcctgggataagcatatctctcccgagactgaagagagcctccaagccagcacaccagagctctgcatccaggcctggagcc

SEQ ID NO: 3199 - DNA, 4377 bp, Homo sapiens
ctcactgtaatgtccacctcctgggttcaagatattcttgtgccttagcctcctgagtagctgggattacaggcatgcaccaccatgcccagctaatttttgtatttttagtagagatggggttttgccttgttggccaggctggtcttgaactcctggcttcaagtgatctgcctgccttggcttcccaaagtgctgaggttgcaagtgtgagccaccatgcccagctgtgtatgctgacttcataagacgacaagagagtgcataaaacacaagggagacaaagaaataaagtcttggctgtggtatgctcagatctgtagacaacatacctcccccaacaaaagaagaagactagttccatgataatccagaaacctttcagaagagttaagagaaggatgcgtgcacagaagtcacgacaagggaaaaaacgaagacactaagtacattcagtttttgtctgctttgttttgctctacagttggtattttcttgaaaaagaatgcaagccaaagtatccaattcttaaacctattatataacacgatgtgaaaaatagtgatgcagaattctgtacttgtggaaattagtttgtctggaaacatctgaggtccttgtatgtaaatgaacattcagaaaaatctctgtattagatctgaactcttacgagaggttttagtttcccagaaaagtggcctcctagaaccacagggaagtttcagacctgttgattcaatggtctctttactgtgccccaaagaatccataaaagagtcttattcattcaacaagcatataatgagtacctgctatgtggcagacactgttctagtactcagtgataaaaacaaacaattcttaccttgccctagaatggaaaaggtaggttgctggtgatctaattgttaagtgcctgctgtaagatttgcttcatgagttaatggtctgttgtgagacttctttaaaagaaaaggttttaataaaaatgaactaacgctatttaaaaatagctagtctactctaaaccttcattttatattaaaattttatggcccaaaaagggaaaccaaatctcctgaggtagtgtggagctggtggcagggccaggactagcacaccacattctaggctccaagtgaaggcttttccctctctctcccacactgttttttggctcttctcccaccccaccccacttgacagactagtctagtaggagctcacagatatggaataaaaaggttagagtctaaatcccagataaatcaattacattttcctggaactcagttttcctggatcttaaaggatacatgtggtttggggaatcaaatcagcccaaatattttgtacataatctgtaaactgtaaaatactatacagatgttagtaattatagtctgagttcctgtgtcttctcattggtactcctcaaagcaaaataattgaaagatggagtaataatagtgaaatgaaaggaaaataaaatgtgtccactggccaaattgttatagttaaaacaaaaaaaaatgaaatctaaacaatcttagttagatgctggccctgctgcttcctatgcaatgtcagtcagtgcagggaggccctgtgggcaatggtgaggcttgagcactagaaagtcagacaggctctgaagtaatctccctgtctccaatttgtcaactgtaaagtggagaagatgacactagtgcctatttcatttggctgctctttgagatggtgctttaaaagcctttagcataatatttaggacacactcaatgctcagtgatgattatctattatttttaattctaaaatatggacaataactcctacctcataggatatttatgaggattgaatgaacgaaagtaaactgtacatccaataagtgagtgatgtctctgaaaggttaaaaatatgttctttaccttttccttcattttttactgatttatgaaattggttgcaaaaaaatatacttactggaggattgtaatttaaggggcatgtgataagccaatttctctgtcagtagctccaaaattttagtatatgtcagaattttatgccaaaccaggaaggcaatcccattcacaattgccacaaaaaataataaaataaggaattcagccaactagggaggtaaaagatctctacaatgagaactacaaaacactgctcaaagaaatcacggttgatacagacaaatggaaaaacatgccatgctcataaataagaagagtaaatatcattaaaaatggccatactgcccaaagcaatttatagattcaatgcaatttgtatcaaacttccaacaacatgtgtcacagaactagaaaaagctactttgaaatacatatggaaccaaaaaagatcccaaataaccaagggaattcaagtaaacagaacaaagctggaagcctcatgccacccaatttcaaactatactgcagggccgtggtaatcaaaacagcatggtactggtatgaaaaaagatattcatttttttaaaaaggcagcagtatccatggaccctcctcctatggagagggagctcagaaatctgatttttaacaaataatttcaacactataacacaaacgatggtgatatggtttggatgtgtccccacccaaatctcatcttgaattgtagctcccacaatttccacttgtcacgggagggaactggtgggaggtagtgaaattgttgagtgcatgtctttcctgtgctgttctcatgatagcgaataagtatcaagagatctaatgtttttttaaaggggagtttccctgcacaagctctcttctcttgtctgccaccatgtgagacatgcctttcaccttccaccgtgattgtgaggcctccccagctatgtggaactgtgagtccattaaacctctttcttttgtaaactgcccagtctcaagtaggtctttatcagcagcaagaaaacagactaacatggatgggtaaacacttcttgagtggtgtaagcccttgttactcaaactgtgtgttctggcagcaaaagcaactccctggggatttgctagaatcacagaatctcagctgcaccctgacctgctaaatcagagacagcattttaacaagatccctgggtgacgtgtgtgtgtgtgtgtgtgtgtgtgtgtgtgtgtgtgtgtgtgtgtgtgtgtctaagctctgtctcttgggagttaggtaactgactgtcttcctggatctcatagcttctttttctgttaaaaaaaaaaaagtcattgctcttccttataaatgggagctttataaaagcttaatagaaaaaaagaacatattaagatatctcaatatttctgctgaattattatcagaagtttttcccattatattggtcagtgtctttcatttaaaaggctgtatgataaatggattttagaaagacaaaatctcttttaaaatatttatcttctgaccatttttattttatttttaaaaagggaatgaaaatcatttggaagtttttcattggctactacctcaaagttaaatttgatattcagttacagtaactttaatagcccaggtttggatatgttaatccccctccctatttgtagagctttttgctgttctactgcttcttaaagattttttaaacatagatacaattaatatactataggccaggtgctatggctcatgcttgtaatcccagcattttgggaggctgaggtaggtggatcacttgaggtcaggagtttgagaccagcctggccaacacggtgaaaccccatctctactaaaaatataaaaattagctgcgtgtggtggtgcatgcctgtaatcccagctacgtggtggcttgaggtgggacaatcatttgaacccaggaggcagaagttgcagtgagctgagattgcaccactgtactccagcctgggtgacagagtgagactccatctcaaataataataataataataataataataataataataataataaatatactctaaagctcaaagccagattattttcacatatccatgcacccatgtaaaaatagttacattgcaccccttcccagtcaatagctcccaattccaccccaactattccaacttctatcactatagattagttttggccattcttgaacttcatataaatgaaatcatagagtatataatcctctgtgtctgctttctcttacttaagatcttcaaaatacatccatgttattgtatgtgctagcagttcatcctttttattgctgtgtagtattccattgtatgaatacattgcaactttttatccatgcttctgttgtgggcatatgagtaatttccagttgggagtattacaaataaaactgatgtgaag

SEQ ID NO: 3200 - DNA, 5760 bp, Homo sapiens
caccgatcatggagatggatgagggaagtggggtgtgtaggaagggatgatgcccattgatgatctaaagaatattgtgtacctgcttacagatttgtcgtgtttgaatataatttttaaatgttttcactaaaaagaacctggcccctttaataaaggagcagtatgtgccagccatcctgagactggtggggaaaactgctagaagcctatgacatagctcagcaataaacaaactcccatgtggatataaataacttatcacaaacaccagaaccagtggagaaaaggctgccaaacctcaggctcaaatggcacttgggacaggtcatgttagaaaagagccataaccagaaatacaccagaactccagaatagagaaggtcacaggacaagtctcaacaaaattacccttgtttggagaacttcaaaaaattatcagatgagaactcacagaaggtaagtaaagggaaaaaccaatagctccattacctcaaaagagaactccactggacaatttgagaaaattgaagactgtgccagctaattcatttctctaaattcagcagtaataggcagctgaaaaagaattataatctaggactacctgtttcaaatagccatatgttttttaatatctctgagattctccttagccattttgtgatacgagttttattttaaggtggctcaaattctcttaataagtagaaaataatgacaaatgagcacactccaaattcagtcttttatcattttaattaaatatgtcagtggcctttcctgttagcagaaaaatatgaaatgtatgtggggaataaatcaagaaaactttcatggatattgtggagcaacttagttctttatgtttgcttcaaatccatgtggaaatagataaggcacaaatactgaataagttaatttatctgaagcttataacaatgtcaaatatattacttttataagggatctttctgaaacaacacattaaaataccatctgaaattggtttctctagaccctgactagccatcttcttacatattttactccaaaacctttttctgtacaacatgcgattgtttctctctcttttaaaatatattaggatctgagaaaagaaatatattttgactcagatatactacagattgaaggcctccaatctggtcaacataatccaccatattaaatgttcaagtttaattggcttgtctcattaaggataattagttaaggctataaatgacttacctcactaaggatgaacagttaaggctataattaaatccccattcctgtggccaggtcttaggaaaacataaccaaaagacagctaagcccctcaattccagtgtaaagggcctgatgcagaggaagagggaaaagcttgtcttcagtgctggtttgctgagtatgtgtgtattcacacaggggaaactataagagatatgaggccccttcataggatcaggctggctccacatctgttctagtcttaagataccttgagtcccaactctacttcctgcttttccagtgtgtggaactttgccagcaaacatgttccaggaggagccattaacaactcatattcataatccacatgtcttccatgggaaagaatattctgcatggcagtgaccttcctaacttagcattaaacaggaattattctaggtatatgttaatatttcatttaatccaagggcagggatgcaaacaggcttcaagagctactcaatgaacaaagcactagaaagccatttggaaccaaggaatctatcctttcatagttttcaagggcatgaggtttcaaacttctctccctcccttccttcctcattcctccctccttccctccctctcttccttccttccttctctctctctctctctcctcacctccctcctttcatctctctctgtgtggaccgaagttctaagttcttttgttatttccatgcacatctgaagcatcttatatgtatgaggtacctgtggctcttaaatgtccaagatacctagtgtgtttcactttcaatttcaaattcactagatatagaattaaatatagaacaagtggaattgcgtgcttatccctaatccaatcatttatggccggggagatttggttccatactagataatggcagctgagatccatttctgtaggttaggagtagattataaataaaggatgttgtatgtgggtccaacgacccaaaaagtatctcttttattgagtcatagaaagttgaatcacgcgaagtttagctagccattcctatctacattaaagaaatttagaattataccctaattcagtatctttctacaggtggtcaaagactggtataaatatctatctagttcatatatctttatttatatttatctattgattgatctatcaatctgtctatatgtgatctatactacacatatctatatctttctattgattaatctgttctatactagatatatatgtctatctttatctattgtaggatatagatgtatatagatatgtttagtagatatatatataaatatatttagtatatctatttctacacctctttatatacattgatagagatagagatagatatatctgttatagatcacattgcaattgccaaaagttcagctctttttccagataggccagtgccaggatatgttcagaggactcttcttggtaatcctgtagtaggcaactgctaccactctggtggaatgatgaatcaatcatatctgcaaggactgacaacagcaggaccgggcaatctccaggaacctgatacagcctggaggcgggcaactatggtgccccttctggccatatacctgcctgacttgattattaccataggaatacatagtttgaagaaggcttgaaaacaattacaatggaccaggtgctacccagcagaaagagaaatttaagggaccccttttacggcagagtgcatctaatgcaagaaagtaattgtagaagaaactaactcttccatcaagctttgtatcatattatacatcagataagctcatcaactgtgaaaattttaagctttatgcctccctacttgaaggctcttttgaacaacatctgctggagttcttcaaccagtaaataaagttattatgcagtccatattttaccttttgttcataaaaatgattcttaaattttttttcataaaattctttcttcaagttgagataggctacatgtccaaattaaagacaaataaaaatatatcagcaattatattacatgtgagtgaaataaaactgcaagacaaagtttgtcaagctgggttaaagaaagcaaaacaaaatacttcttatacacctaaagttgaaagtaaaaggatggaaaatatataaaacattaacaaaaggacaattgctaatactgtattaatgtaagactcagtacaatatatttaaagtactaatagacacaaaatgattaacttaaaatggtcagttcaacagaatattaaaatcttaagtttgtatgcataaagtagaatgattcaaaaggaagaaataaaactttttattgcagatgctgtaattgtgcacttggaaaattgaaaacaatcaacatataagtttttaaaacaaatacagtaaatacattttgtgagatcactggatgtattgtcaatatacaggaatcaattatggtgtgtgtgtgtgtgtgtgtgtgtgtgtgtgcaacaaacaaataccaatttaagaaaaatactgtttttaagaccatcaaaaagcaccaaacgctaggagaaaaactaatgaaagttgtgtatgagctctacactaacaactattagctattaccaagaaaaattaagaaagacctacatagatggatatgtttaacatatttatggattagaagaaacaatatttaaatctgtcagttctctccagattaatctgtagcttcaaaataattccaatggggtgtgtgtgtttgtgtgtgtgtgtgtgtgaaaatcaacaaaacaagtataaaatgtatataaaaatgaaaaaacccagattaataaagatgatcttgaagatcaaagctggaggtgttacactactggatttttaagtcttataaaactacattaattaaaactgtgatttttgaagcaagtttagataaattaaccaaggaatagaagagaattcaaattgtatccatacttataaggccatctgaattatgataaagatgtcattgtaatgcaatggggaaaattggttgtttcaataaacagtgctgcatcagttgaatactaggccttactactatttcactctgttcacaaaaataaatttcaggtggattacaaatctaaatatgaaatataagacaataagtcttctaaaataaaatctaggaggatgacttcaagaactcaggtttgcaaagatatcttaaacaaaacacagagagccctaaccacaagagaaaagactagtaagttgagttttgttcaaattaaggaattctgttcatttacacacactatttaggaagtgaaaacataagctacagagtgggaagacataaataatttctacaaagcaataagtaaaattaacccaattttttaaatgagcaaaatactttacaaagtagtgtgatcaaatgactaataagcatatgaaaaagtggtcaaaaacattacatatgagatgaaaatgcattaaaacctctgtgagataatactagaaacccatcacaattaaaaccaatcaaaagtaaaaggtttgacaaccccgggtttgggtgagggagtaattggctttctaatactgctggagggaatgtaaattaatacttactgctttggaaaattagcattaacaaactgctgtgacacacaacaacatggatgaatctcacagatactatgttgagcgaaaaatgtcagacaccaaaaatcacagatagtatcattccatgcgtgtgcagttaaaaagcaagcaaaactaacctccagtaatagtagctgggatagcatttactttttaagggttactgactgggagacagcaaaaggaagctttctgcataatgctctccattcacggtctgattggtggaaatactcatttttaaaattcttctagctttactcttaagattgatatacttcattgtatatatggtatagcccaattaaaatgtctgtaaaagttatctgttgaaaaaatggtttgctagaagacaaaataataaaataacaaaaataaataaaccatttgtaaaagttatcaaaggaaaacagaatgttaatttactctgggtcatttctaataatataaattgtctttttaaggtttataacatgatgttttaatacacacatacatagggaaatcattactattgtcaagcttaataacattatacatttcctcacatagttactatgtgtgtgtctatatgttccatgagagcacctgaaatctagtcccccaacaaatttccggtatataatacagtattattaactataatcattatgctgcacattagttctctagacctacataccctacataattgcaactgtaccctatgaccaatatatctcctccacttcctcgcttctggtaccatttttctactctctgttgttgcaaatggcagaatctctttttctttaaaaggctgaataatatttctctctctctctctctctttctctctctctctctgtgtgtgtgtgtgtgtgtgtg

SEQ ID NO: 3201 - DNA, 2389 bp, Homo sapiens
gacagggtctcactctgtcacccagactggagtacactggtgtgatctcggctcactgcaacctccgcctcccaggctcaagtgattctcctgcctcagcctctcgagtagctggaattacaagcatgtgccactaccaccctgctaatttttgtatttttagtagagatgcggtttcaccatgttggccaggctggccttgaactcatgaccttaaatgatccacccgcctcagcctcccaagtgctgggattttaggtgtgagccactcgcctggcagaaagactgtcttctgaaaaggacttttgggagtgaaataacatcagctctaagtgactcatgtgcctatatccacctggttggtggtgaagaggagttgaaaggaatgaaggattctaggacagaaggttcctattgagaagacactttcggctataaccactgttacgtgtgtgtaatttattcaacactactgtgtatataacggacaaacaaatcatatttaaaacatcatctagtctttttagatgtttagaagtgcacaaagtatgttaaaagtagaggtaaataacacattttgtagatatccttttgatgtgaaatattgtcttttggaaattgagcaaaccaattccctgagccgtacacattattatatctgtgtcagtttggggaggaaggaggagcagaaagtacaaagggcttttcaccagtgtgtttatggtgaggcacattgactattatctttttttttttttttttgagacgacgtctcgctctgtcaccaagctggggtgcagtggcgcaatcttggctctctgcaacctctgcctcctgtattcaagcgattctcctgcctcagcctccagagtacctgggactacaggtgtgcaccaccacacccagctaatttttgtatttttagtagagaaggagtttcaccatgtttgccaggatggtcttgatctaagtctgcattttctttgtgctgtgtagatagcgtacataagaggacaaaccaatcctaatctatatcatctagtctttgtagatgttagagaggtccagtgcgtgacaaaagtagatttagtgaattaaaacactgagtacgttttgtgttaaaattcatagggaagactgttgttaaaaacatagaagtgggcagggcacggtggctcacgcctgtaatcccagcactttgggaggctgaggtgggcagatcacttgtggtcaggagttcaagaccagcctgaccaatatgatgaaatcctgtgtctactaaaaatacaaaaattagctgggcatggcagcgggcacctgtaatcccaggtacttgggaggctgaggcaggagaattgcttgaaccctggaggcagaggttgttagaatcctttctacacaatacatttggcttatagctgtccacagggtggacagaggttggaacgggaagggttctaggccaaaatgttcaggggaggggtgctaggccagaatgttcgtatttagaagacactttcaaattacagtctatgttatgtatatgcaccatttattcaatgctactatgtatatagtggaaaacctaagtcctctttgaaacatctagtctttctaaatgtttaaaagtgcacaacataggttagaagtagagggctaaagtgacaccctttaagcattttctttattactttttaggagtgtttgcatttggaaatggaatggttaaacttgatgctttggactgttcatagggtgatggtgggtgtaggaggaggaagtatgcaaagggaagggttctgtgcccaagagttagattagttcacatgatctaaccattgttctatatgcattttagttaatagtgttttgttttttatttttgatggagttttgctcttgttgcccaggttggagtgcaatggtgtgatctaggctcactgcaacctctgcctcctgggttcaagtggttctcctgcctcagcctcctgagtagctaggattataggcacacaccaccacacctggctaatttttttggtaatttttagtagattcggtgtttcaccatgttggccgggcttgtcttgaactcctgacctcaggtgatccacccacctcagcctcccaaagtgctgggattacaggtgtgagccaccgcacctggccaatagtgggtattaaaagataaacaagtcttaatgctcaaagtatgttaaaaatagatgtagtaaaacaatccgtctacaaatgttcttttgttatattttaggaggcctgtcttctgggagtgacctttgttattccacctcttggagctaggcatagtcctatacctagtcactgggatggtggaagagggagaaaaggaaggatgaaggaaagagct

SEQ ID NO: 3202 - DNA, 1305 bp, Homo sapiens
agcgtcacgccttcttcctccagatccctcgcacatgctgttccctcatcttgaagtgtccttctgccatttataaggacctgatgattgatttagcatctttggcatccggccactgctctgcttggccatactgctgccttcaccctcagctgttgcaactcttttggccactttgtgtaactgccctgccaagccctgcttcctggctgtccaaagaaagaagtgtttcctacaggagatcacaacaaaaggatgaaatctggggtgcaggggaagggtagcttctgaagctggaaaataaagaagtaaggaagggagactgtggaatttaccagggagggaaactaatatttcctttcatataagttggtactattctggctttttaccatgatcatatattatattcaaaataaagctcttgtttttgaaacaaaaaaatataaacaaaggaaggaaggatgttcatttatttagataatagatacctagtgaacccctagtagaccttgtactgggtcctggggacactggtgaccaggttccattcctgatctcctggagcaggggacacgaaaagacattaagcaaataattacacatctttttacatcagtacaaatgttgggactttgcaagagttccaccctgaaagcttctgttttcactgaaagagaggaggcaaggtcatttgttcataaaagcaatggaattgagtaggggacttgaaagaaatgatgaggctaggaaaagcagctataggaaagggggcaccagtcagactaagaatatgtaaccagagcacagctgtgcatactttgcttgaatgtctccaagttcaaatccaagaacttgatattttaggttgattctatgtgtaacctatttgtttttaaagagtagagtctttttcttccagcatgtgttagttagccctgtctttatcacatcaccaccaccaattgtcatttgcagaagtatcttcaactcatcataaatttactagtaatagctaactcatgtctatagaactgttaagtgacaagataatatttagattaaaagctatagttgcattcttattagagacttaatcagattttaacatgctcctcacaggggccatttagccctattctgctgggctttggcaagcactgaatgattgccctcctagggcagaggtactgcagccctggttaagcattgaaaagatgatattaccaataagttgactctaattgtaaacaacatatttaaacaattacatcttaattaaattcttataaattataagtgcct

SEQ ID NO: 3203 - DNA, 4032 bp, Homo sapiens
gttttgattcagtgtcaccgcaatggagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgatcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtt

SEQ ID NO: 3204 - DNA, 18492 bp, Homo sapiens
aaagaatatatatttatatatataaatatatatataagataaaatatatatatatttttccattttgaacgtattgggttttttccatgctgtttcctactctcctcttttgcacccctcccatttccttcgtttttcttcgaaaatttcttccccctccagttcgctgtccggccctcacatgtgcgagaggggcagtgtgtcgttaatggccgtggcgggcaccgggctgctcctgtagtgctgggacatgtgaagttggctggggcggcgtgttccggcacctcggcgcgggtaaggtacgtgctgatcaggtcccggaggtccccggcctggcagggcgccctggagtgggaggaagaggtaaccacagcggggctggagtagggtgccctactgcgagtaggacgtgctgtaggtgggcgagcagttctcgcaggtctgcgaactggtcatggagttgtactgcagggcgcccacgtcatagcggtgtatgggctgcatctgcgcggcaccgttggcgtggaggcccgggtgctgtgcgtagcccagctggtcctgcatcatgctgtagctgccattgctccagccgttcaggtgcttgtaactgtccatgcgctggttcacgcccacgcccagaccggcgcccaccccgaccctgttgagccaacttttaagttgccacatgacacatcttgtccatcagacctatatcacatgatcacactgagctgaaagagaaactttaaatgtcttcattctgtatgtccagttgtataccaaaaactggaagaagggaaggacatcttgggggacaactggctctcttatgacaatccaccgctttgaataccaagttttcatgcctcatttttttttccccagtgtggaagatacccatccacaagagagtgggctcaaagtgactgcatttacttctaaatgtgccatactctctataaggtcttaaattagctccttgttatacttcataaatgaaaagagtatcttcccctacgtacccagagtgtagtaacaatttcaattcagaaagggaaagaggccgggcgtggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgggattgcgccactgcactccagcctgggcgacagcgagactccgtctcaacaaaaaaaaaaaaaaaagaaagggaaagaatgggcaacacaactctcactagttcctaccagttatcaaatccaccgccactatcccccagcagaaaagcgggataaaatacgggactcatctatttgaaggcagtagaaatctgtccaagcaggactctaaaaaggagtgaacatttctgaggtgagctgacctgtggctgcttttagtttgggggcacttgtccattctggttgcagaccggaggctggtaattttgattttgtatttttttaaagcttgcctccagaggacagcaaccaagaaagcttttggtagagatatggaacagccttaaacatgggcaatttccactcagaaaatttgcaaagttgtggtgctgtttaggagagaaaacaaaagtaggcagaaagcttcataaaacaaagattaaaaatcaggacttgccagaaggaggggatctggagaatatcctaggtgaccattagaaaactctgaggctaggggcacgtcaaatgtagaatgagccttatgccaagatttgtaactctgccttgatttatcatgattcttggttggattaagttctagcagaagacaggttgcctcactgaagaaagacatcacccaaagccagtaacattaaaacatctggaaaccaatggaaaattacaagaaatgccaaaaccacatggaccacgtgaccaaaaactaagagaaaaaaaagtgacatgagaaaccaagccacagacaattcacatattggagttcactggcaagaactctaagataactatgactaatgtgtttgagacaattatggataagataataggcaaagactttgatcagaaaagtaatctataaaaatcaaatggatattctagaactgaatacagtgtctggagttgagaacacagtaggtggatgtaatagtggatttgtgtaacaaaagacaagattagtgaactacaagacaggtcagtagaaaaaaatacatactgaagcatgtattggaggcatgtaaacacaatgaaaagcctttagaaagataattggagtcttggaatagaatggggccaaagtaacatttgaccaagctcagaaaactaaagcaggacaaagaaaaatagaatcacacttaggcacatcaaagtaaaccaactaaaaagtaaagacagaaaacatcttaaagacagccatctcccacagaaacaatggaaaccaaaaagactagaataatacttttaaagtgcttacagaaagtagctgctgatctagaaattcataccctgcaaaaaatatccttcaaaaatgaaggtgaaatggggctgggtgcagtggctcacgcctgtaatcccagcaccatgcccggctaattcttttgatttttagtagaaatgaggtctcactgtgttgcccaggttggtcttgaattcctgagcaaaaaagattctcctgcctcagcgtcccaaattgctgagatgacagctgtgagccactgtgcccattttgtttttggtttgtttgttttttaatttggctcttttagttgattttcatgggagcattgatctagagcaagttagtacatcagtagtttccaacctcgagatgattgtgtcccctccccaggggacctttggcaatatctggagacatttttgactgtcatagattggggtcagtgaggatactactggcatctagtgagtcaagactagggatgctggttaacatctgtaacaggatagccctctgtaacaaagaattatctttccccaaatgtcattagtatcaagattgagacatcctgcattataaagttttgattttagtatttttttaaaaagctctctgatttcagatatttttctgattttacatttaaaagaccttaaatggcacacaaacggtataaattcaagttgatgaacattgagttcaatgtgagttaactgaagagaatagccattggattcttatgtcacccctatttatctctctagagatatatggaggataacttggtggacaaaatacagttagaagctgagaatattggtctcaatttcagctgagaatttgagatgaaacatgtatgcttggaagtcatttatacacagctgttagttgaagctattgtaatgtataagtcttctcatttgtaaagcacaagagagcagggccaaggacagaactcttaagggcaggggaaggagggaagaccattggtgtttaaggactccattcctccatatgatcaactcaatagatgcaaaaaataaattgacaaaatgtaacacaataatcaaacatccatacatgatagaaacttccagcaaactagaactagaaacgaacgttcacatcctaataaagtgcatctgtgaaaacttacagcaagcatcatacttaaagtgaaagactgaaatgctttctctctaagatcagaaacaaggtgagggtgtatgctcttaccacttctagccagtgtaataaggctaaataaataaatgagtaatatccagattagaaaggaagagatgtcttaatttgcagatgacacaattatctatgtagaaaatcctaattaatctaccaaaaagctaccagtaccaatacatgtttctcaaggtggcagaatataagatcaatttgccaaaatcagttgtatttttatatagaagcagtgagcaatcagaaattgcaatttaaaaataatgtaaaaaataataaatatttaaggataacctgccaaaagacatgtgagacctgttcgctgaaaactagtaaacactgctgggataaataaaatctaaataaatagacatattgtatttatatattagaagattcaacattgttaagatataatttattctcaaattcaactatatatattcaatacgatttcaatagaaatcctagcaggcttttaaaagaaattaccaaatttatatgaaaatgtaaagaacctagaatagccaaaacaatactgaaaaaagagctaaatggaggatttacactatctgatttcaagatctattaaaaagctacagtaatcacagtataaagaaaggtaaacagagacaaatggaacaaaatttgtccagaaatagacctacagaattgattttcaacaaaggtgccagggcaattcaatgggaaaatgataatattaacaataaatggtgatggagcaaatggatatccatataaacaaatagtgaaaacaaagaacaataacaaaaaacaaatgaacttcaatccttatttcacaccagcattcaaaaagtacttcaagataaatcatagtcctaaatataagaggtaacgtataaaacttcttgaagaaaacgtaggagaaaatctcagtgaccttggcttggcacgtgtttcttaaactggacacaaaaagcaagaattattaaagaaaaataaaatggatatcatcaaaataaaaaatgtttgcctttccaaagataccgttatgaaaatgaaaatataaactacaaaatgggaaaaatagttggaaaacatatatccaagaagggacttctacctagaatacataaaactccaataataacaacaaataattataataataaatgtaataatataaaaagtatacagatgatttgaaaagtcacttaaataagatatatgaatggcaaattagtatatgaaaatatgctcaacataaatagtaatgaaaatatgaattaaaaccatacccactagaatggctaaaactgaatagctaaaattgaaaaaaccgataccaagaattgacaaagatttgggacaactggaacgtatactgatggtaggggatgtaaaatggtacaaccactttggaaaacaggttaccagtttcataaaaagttaaacatacacttatgactgagccattccacttcaaggtatttatgcaaggtatatttcataataccttgaaatgaaaagaatgtatatgtccacacgaagacttgtgcactaaagttcatagcaactttattgccccctaatagactacaaaacctaaatgtccatcaacaggaatatggataaacaaatcatggtctatctatacaacataatacaagttagcagtagaaataaactgttgatacacacacaacttggatggatctaaaactaattctgctgacagaaaccagacaaaaagagtacacattgtatggttccatgtatataaaattctagaaaatgcaaactagtctatagtgatagaaaacatatctggttgtctcaggatggtgaaagggcaaggagggcataaaggcagggattataaaggggccataaggaaagtcttgggggtgaggaatgcatttattatctttttttttttttttttttgagatggagtcttgctctgttgcccaggctggagtacagtggtctgatctcggctcactgcaacctccacctcctgggttctagcaattctcctgcctcagcctcctgagtagctgggactacaggcgtgcaccaccatgcctggctaattttttgtattttagtagagacagggtttcactgtgttgcccaggctgatctcgaactcctgagctcagccaatccacctgccttggcctcccaaactgctaggattacaggcatgagccactgtgtctggcctccccgcatttattatcttgattgtgataacaggttcacaggtgtttacctatgccagaacttgccaaattttagcagtttaaatttttgcaattaaaccatataaaaaatacccctaaaaaagaaaaaaatgggaaaacattaaaaatcgttactgctataagatcaccacgcatcctctgggtaggaaataatttctaactcttctttatccccaaatcactttttactttcattatagtacttatcagatgtctcagttatccattatcccaaaacttagtggctgaaaacagtaatttgctatttctcacatttttggggtcagctgggcaatttctctgctggtctagcctgagctcactcagggggctgcagccagctggtgagttcgcagaagctggagggtttaacatggctttggcatagatggcttgaaggcggcgactctcactacatggtctttcatcattttgtagtctaactgaatattttttttcagtgtccataaatcaagttttattggaatacagccacatccatttatttacttttttagtgagatatgattgtcagacaaataaagctatatatattcaacgtatacatcttgatgcattggaggataagtatacacctgtgaaaccatcaccatattcagtgccctaaacttaaccatcacctcttaggggactcctgtattagggtcctctgtaggggcaaaacttacaggatatatgtatatatgaaaggaagtttattaaggagaattgactcacatgatcacaaggtgaagtcccacgataggccattttgcaaattgaggacgaaggaagccagcagtggcagtctgagtcccaaaacctcaaaagtagggaagctgacagtgcagcctccagtctgtggctgaaggcccgagaggccctggcaaaccactgttgtaagtccaagaatccaaaggctgaggaacttggagtctgatgttcaggggcaggaagcatccagcatgggagagagatgaagactggaagactcagcaagtcagcttgctccaccttcttctgcctgctttttctagctgcactggcagccaattggatggtgcccactcacattgtgggtgggtcttcctgagggtgggtcttcccctcccagtccactaactcaaatgttagtctgttctggcaacacccagcaacaaccagatacacccagaaacaatactttgcatccttcaacccaatcaagatgacaatgttaaccatcacaccttgtacactattggtgggaatgtaaattggtacagtcactatggaaaacagtatggtagttcctcaaaagattaaaaatagaactaccaaatcatccaacaaacctgctactgggtatatacccaaaaaaaattgaaatcaggatttcaaagagatgtctgcattctcgtgttcattgtcccattattcacaatagcaaagacatagaaagaacctaaatgtccagatgaatggataaagaaaatgtacatacaatgaaatactatttagctttaaacgagatgagaatcctgccatttgctacgtcatggatgaatgtggaagacatgctaaatgaaataagccaggccaagtgcggtggctcatgcctgtaatcccagcacttcgggaggccgaggcaggatcacttgaggtcaggagttcgagaccagcctggccaacatggtgaagccccgcctttactaaaaatacaaaaaagtagctgggcatggtggcgggtgcctgaaatcccagttacttgggaggctgaggcaggagaattgcttgaacccgggaggcagaggttgcagtgagccgagattgcaccactgcactccagcctgggcaacagagtgagactctgtctccaaagtgggggaaataaaagtcaaacacggaagaactactcaattattccatttaggaatctaaaataatcaaactcgtagaagcagaagcagagacttgaatggtgattaccaaggtttgggggagggtgaatcagagagatgttgatccaagggtacatagtttcacttatgcaaggtgaataaatcctagagatctactgtacaacatcgtgcatatagttaacaacactgtattgtgtacttaactgaatcttcatgtggcagtcgggtacctaatgaataaatgcagaagccatgaggtctcatgggttgcccgggtcctagatattgcactgtcactcctgccacctttgaccctttatcaaaacaagttttaaaaaacagcccaaattcaaggggatggagaaattgatgccacctttctgatgtgagaaatgactatgccatattgtaaagggacatggacacggagatcattaatataatgatttgcccttccaggttatgccttataggcatttttggtacctgtatcccttctattaaatcataagttccttgaaggcagaaattagatcttatttacctttgtatttccctttgcaacgatcacagatgttgcacgctatgcaataagtgttgaatttttccggatgacaagacaagtaaaaggtaagggcaaaaaaaaaaaaaaaaacaaaacaaaacagggttgaagacgaagacgcatcgttgtagaggtaggggagaaaagatatattccaaataatttaaaatcatgatctccaaagcaggcaaaagcaaagggcaaatattgatgagccatcagagtatcttttttttttttttgagatgtagtctcactctgttgcccaggctggagtgcagtggcgtgctcttggctcactgcaacctccgcctcccgggttcaagcgattctcctgcctcagcctcccaggtatctgggactacaggcacacaccaccgtgcccagctaattttgtatttttagtagagatggggtttcaacatgttggccaggctggtctcaaactcctgacctcaagtgatttgcccgcctctgcctcccaaagtgctgggattacaggcgtgagccactgcgcccagcccagaatatcttaataataacatttttatagccaaataggtaaaggcaacagataagaagagttgagtagctgcttaagtagctagagctttatttaaatacagctcttttgattccaaattttaggctttttttccccttcttcaaattttgcaactctggggtggtattatgttaggcaattgaagggaggggtggataatttaggggttttaaattcacagagtaaacattctggtggttggtaccatgcttttagtatttatatttcccagtgtatgaaataaaagattttagagggacaatgctgaagatgcctaaaataaactttccttatttatttctaggcctttctaagcagttagattccaagagacaaagtatgttgtagagctgttctgtttagtcttttcctgaaattgcagccagtgttttgcctatctgctattaacacattaccctttgcctgccatctcatatttggcatattttataaacaggctgaaagctctaagctgaatcctggctatatcaggttttgtaattatatcttcctgcaatattcttcccactcagacagctaataaatagtttaactgactgagattcagcctttctctttgtctctgcaaaatttagaaattcaaaatgcaattcaaaataagtattttcttcatgtactttccccatgatgtatttggtgtccaacaatgaaccaaattatgaggaaggtgagtcaacagaatcatgagatccaattctttctcttgagactcttatggtatcggagagatttgcagtctatttattttttattttatttatttatttattttttggaataagatctcgctcttgtcaccaaggctggagtgtagtgacacgatcactgccacctccgcttcctgggttcaagcgattctcctgaatcagcctccccggtagctgggattacaggcgactgccaccacgcctgctaattttttgtatttttagtagaaacagggtttcaccatgttggccaggctggttttgaactcctcacctcaagtggtccgtctgcctcagcctcccaaagtgctgggattgcaggcatgagccaccgcccggccagatttgcagtcttttgggtattctgcaagctccaggattctgggattctgagtgacccacaaagttcacagtgttgctgccaagttctagtaaagcattatgttatacttttttgtttttacataattcaacgtattgggcaataagtcactttgctagtattcatattagttaatctttactctgcagtaagacttaatgtaaatgcaaccttttaaaataaaaacgttgaattattccagttgaggaaaagtgcaagtagcaatcttagagggcaagacatcagttcggtttaaattagtgaattaaattctccatgatttcgtggctccctgtggataccatgaacactctgttttacctcagttgtgccatgcctcaacattgagctcctagaatgcaaaggctatttctaattcatttgttgtgtctttggtatttgtcataatacaatactatagattattcctctttctatgtggttttaaaaattaggatcattatcaattttgaacttctgaagtcttgatgagagagttgtaaactcattaaagataaatgagtagatttaaactattcacgattcttcagggttctttttgtgccttgagtctctgaggggaatggttgctgctgataagcctagccaccagtcacgtaagaagatattaatatacagcaatttcacagctgaaggcttttgcttttccacagctatgttaatagtatttgtcatttggaatcaaacaagtccaggttattcaattcccgggggtgggaacttacacaagagaattaacttctctgagctcaagtgcccctgtttataaaatggggacaataaaatttataaaatggtgacctctgttgtagggttataaggattgaaattctatgtgtttagtgcctggtaaaatccttgacatgtagaaggtgctcagtaaattattgtagtaaaaatacaagttttttttttgggccaggcacggtggctcacacctgtaatcccagcactttgggagtccgaggcaggtggatcacttgaggtcaggagttcaagaccagcctggccaacatggtgaaacatggtcactactaaaaatacaaaaattagctgggtgtggtggtgcgtgcctgtaataccagctactctggaggctgaggcaggagaatcacttgaacccaggatgcagaagttgcagtgagctgaaatcacgccactgtagtctagcttggggtcactgagtgagactccatctcagaaaaaaaaaaaaaagacaccagtttttaacagtctttctcctcccttcaatttggttgtaaaatattcgaaaaaaaaattggaacctgtacatgttttgacctgaaaaatagtgggaaagtgaaaacattccactttccctttcggcatttattgtgtcacttaattattttaagtattgaattttcagtctgtcagacacatttctgatgaaagttaagtgtgatcagggctcactgcaacctcaaattcctgggctcaagctatcatcctgcctcagcctctccagtagttgggactatagggatgtaccactgtgcctagctttttttttttttttttttttgtagtgatgaagtctcactatgtcgcccaggctggcctcaaactcttgtcctcaagcaatccttccacctcaacctcccaaggtgttgggattacaagtgtaagccaccacgcccagctaaaaaacaaattttaaagttatttgtgccactgctactcctaaaatgaatatactgaaatgcaatgatttggatcctcccaatattttcttgtgttatgagaagctgataaagtcttatgaaactcctgtgggattattgaaataatatttaaatctaagtcttaggtcttgtgagatcctaggcaagtcatttagctcatatgaaaaatgagtactacacattattatgatctcagatttgctttaagattgaatgaaactttgcatgggaagtggctttgtcattggaacagctgttatcttataataacactgaacaggccgggcgcatggctcacacctgtaattccagaactttgagaggttgaggcaggagaatcacttaagtccaggagttcgagaccagcctggccaacatggcaaaaaccggtctctactgaaaatacaaaaaactagtcaggcacacacgtgtggtccctgctacttgggaggctgaatcaggagaatcgtttgaacccaggaggtggaggttgcagtgagctgagatcgcgccactgcactccagcccgggtgacagagtgagactctacctcaaaataaataaataaatacatacatatattcatacattacaataacactaaacatccatagggtaaaaaatgggggctttcatttgatggaaaacttcagacacagctcttttctcatgtgaaacaggactgactaatatccgctggcttcctcagaattggttaagaggagatacttgatatcccggcacctttttctgataggctgttgactgtagccttagcctttctcagcccctggcctgactcctccccttccctgggttgtctatatctaccacctctatatctaccacattttatttatgatggttgtgttgtggggtgaggtgggaaacttggcactggctaggtctcctttgcaatcagcctccctacagagaaattggccattaataattgtattaggaaacattttattcttgcagagggagacccatgctttacaaaagattcctgacatttggtagcttggcctagttctggggtgcaaaattaggaagcccatcgttgcggcatacctcagccatatttccacccctacctttatcagctgtaaggctgttatttttatcttcaactacctggcttatttattttctcaaaaagttcagaactcaaatgggaaaaagtagtattctttattaccccactgaaaagtaagggctaatttatccaagtctggttcctcacaggctggcccctgaaacactccacagaaaccagctactgctgtgagtttaagacaatcaacccaacttatggtagaattctgaagtggcggtttggttggattgatgctcacccaacctaaaatactgagttagtagaccatagacctgggctgcatatggaggttctacgttgttatgcagctgcagcccccaaagcttgaccccagccttttgattttgccaactgctaagtgctgaggtgatgacccaaaaatggaggccaaggttctgccacatcatattgctgggaccatgggtttggaccccagcccttgatcacaccatgggagcagcttatactctctcaatcatgcaaatttttttttttaaagccctacagccaaaagactgaggtttctcttccaatgcttgacgtttggccctgctagattcttctgtgctgtttgaatgcaatgggcaacagggctcacatacctgcgatgggtcttttctctgaatttctcccctccctgtcaatgttccagaagggcctgctgtgtgtgtgccctgcttgacccttcacctctggtactgtcacccgtaaccctcagcatctgttcagaaacagtgatcataattcatccagaggtctctgatgattcatccagaggtttcctaggcagggagcttgaattctgagaacttcaagatcacaatgaatgacagagatggttctttaacaccgaggtctttggtctctaaattttatgttatttgcctgggagttggtacttccataaacaactattgggtcacagagaaaggcctgattcccttgttgctgtgggaatagttaaatgccttgtcttccagaagtctttttattaaccccagacagcagttccagtgatggatttcactgtaaataagaatagctcatttttctctgccctctagagttctttttttttagtagatttttcaaaattttactgaagctgaagaaaaaaaaatatatatcaaaattgatagcacccagatgctgcagaagtagtgctgcaggtgaaagataccaggctgagacgaatctggaaaaacgggactcttgtagtcggagctccaaggaaagactggataatagaaaaggaaagatggaaaagccagaaagaaggagatgttataagaaagaaaagtatacaccacacacatatgcgcgtgcacacacacacacacacacagagagagagagagagagagagagagaaaacttataaaattttgagtctgtccattggtaaattactctgttacaagccggcaatgaaatttgaatggtagtttccattgctcaatcccatgggaagttctgagtgtgtagagcagtcaggccactttcagtactcttgggacctccgcagaccaggagggactgtgatcttgagatcttgatgatgctcaacatgtatcttggttcgcaaagcatcttcatgcaaaggatctcgttttagtttcacaacccacccgctgaagtagctgagtggaaactctccccttctacagataagggtagaaaacagtgacacctaggtccaggagtaaagatattcaccccttccgaaaataatttatgaatgatttaaaatagttttgttgggacgcagacacaggtacgggatacaaaatgtaaatgtggagccttaaacattatagtattttatttgattttgtgtttttttattattattattattattattattattattattattattattttgagatggagtcttgcttggtcacccaggctggagtgcagtggcatgatctctgctcactgcagcctctgcctcccaggttcaggcaattctcctgcctcagcctccagagtagctgggatttcaggcacccaccaccatgccaggctaatttttgtatttttagtagagactgggtttcatcatgttgcccaggttggtctcgaactcctgacctcaggtgatccgcccgactcggcctcacaaagtgctgggattacaggcgtgagccaccgcacctggcccattttggtagtttaataaccacacacgcaggaccatctagggcaagttctgagtttgggggctcccttgtgtagttccttctttttgaatctgtgctgaggatgattttctttagatcgtggcagaagtggtactatgctcattgcaggcctcagtcttaagaagtcctaatgacctcttcttttgtactcttgggaatcttaagctgccatgtaagaagtttggttgccactgaagagatcacatggcaaatccacatgaggagaagccctgagattacatggaatgagagagagagagagatagaggagaggagagaggagagagaggagggtaggggaggagggagagatcaaattggctgaaaacaatagctgaccccaggcccagctttcctgtagctaaatgcagccacaaaagtgaccactgtaaagaccagcagaagaactgctcagttgagccccaaaccagattccagaactgtgagaaaatggaatgattgtcattttaagccactaaatttgggggcggtttgttatgcagcaatagctaaccaaatagaagttagctctcagatgtggtttcttctgtaacaagaacacaaagctagtggccatggcttttggcctgggtggtgagtagaagctggaggaggctccaggagacttagtgaaggctggaagggcagtgagcagttggtattagagtctggagaaaaaacaatctgtgtcatgtagtggttgaaagtttggcaacatgttgactataaaagatagcaaatgtgtctaaagaacttggggatctgactaagagactatttccagacagaacgttgaaagtgctaactgtcttcttttagctgtgcctgataaggcacaaatagagagagaaggataaaaaataaaagtgtcaacacaggaaaactttccaacccaggacttactgagttggaaaataaaactctctccccttgcagcttttccagtctgcaaaaggttcccaaatggccttgggggaagaaagatcaaatctaagatgctaccagtaaaatggaacatgtgagtcaagatcaagtcacaggccgggcgtggtggctcacaccaaaatgctggtaatcccagcattttgggaggccgaggtgggtggatcacgaggtcaggagttcaagaccaacctgaccaagatggtgaaaccccgtctccactaaaaataccaaaaaattagccgggcgtgctggtgggtgcctgtagtcacagctactcaggaggctgaggcagagaattgcttgaacctgggaggcagaggttgcagtgagccgatatcacaccactgcactccagcctaggtgacagagtgagactccatctcaaaaaaaaataaaaaataaaaaaataaaaaaaataaaagatcaagtcacaagtgtggctataagaccctttgttaagaccccagaaagattagcagtagaacctcctagaacctcagcactagataaaagtgtttccaagaatctaaaggacatcttctcatagtactctgacccaaagtataaagaggtctgtcacaaagagatttgtgagtatagctcttatctaatggcatgaaacctaataagacttataggaatcctacatagtcttgaagagaactatattagcagaaacacagagttgtactaaaagaaacagctctgcggccataaaaaagaatgagttcatgtcctttgcagggacatggatgaagctggaagccatcattctcagcaaactaacacaggaacagaaaaccaaacaccgcatgttctcactcataaatgggagctgaacgatgagaacacatggacacagggaggggaacatgacatactggggcctatcagggggtggggggcaaggggagggagagcattaggacaaatagctaatgcatgcatggcttaaaacctagatgacaggttgataggtgcagcaaaccaccatggcacatgtatacctgtgtaaaaaatctgcacgttctgcacaagtatcccagaacttaaagtaaaataaattaaaaaaaaaaggaaagaaaagaaacagctcaacttgaaaagaggcctctggactctttctaaaggcaggaaacaggatgagaaagctattcacctacagacactggccatcccttatgggaaaagaagaaatagtcagaaagcagagtaaggaaccatgaagaaccactccctaggaacataactgtccctggagcaggggtaattggtgatatatgcctgtctggacttcagaattgctgtggactggcaagtcctgcattccttccattctccttcatttagatgagagtctgctgtgattattgtatgctggtctcactggtatatggggcgaaacaatttgtcttcagatctagaagaaatatacccaaggagtcttatctacacctggacttggtttagatgacaagatcttgaaccttgagccagactgctgctgtaatatggtgctgcttcccagaggaggtatcagttaacctaggactgaaaggatggattggatgtcacccagggacgaagcgactgtgacaagatacaagcacagggatcccatgagcttggcaggagtgtgtgatctcactgcataggtacagacacagcactaatggaggctgagcacagatggcagaactggagacaagctcccgggaacccaggtccctgggaggtggccctggcctgtggggtgaaaacaccaagtctgaggccaagagcagagctggcatttcccaggctacatgatgaagatgaagctgcctatcttttctgcttcccatttttttttctttttcttatttatttattttatttatttattttttgagacagagtctcactctattacccaggctggagtgcagtgatgtgatcttagctcactgcaacctgtgcccccgcgttcaagtcattttcatgcctctgcttcccaggtggctgggactacaggcacatgacaccacggctaatttttttttttttaatggagtcttgctctgtcgcccaggctggagtgcaatggtgcggtcttggctcactgtaacctccacctcccggattcaagtgattctccagcctcagcctcccaagtggcgggattaaaggtgtgtgccaccatgcctggctaatttttatatttttagtagagacgtggtttcaccatgttgaccaggtgttctgaaactcctggtttcaagggattcacctgcctcagtcccccaaagtgctgg

SEQ ID NO: 3205 - DNA, 1167 bp, Homo sapiens
gtaattttaggtcttgactactctgtcggcaacaaaagccttaattggcaatcaatgtgtgtaaagccatttaggaaagaatgagtgggctgcacgtggccacaggctgctcctacagtgggatcacagggaacttgctcgagaatctgatgttagaggatgttttacagctcctgttctccctgctggaaggacagctaccttttcacagaatagatccctgctcaggaacccactgtgggccaatcaacagcttcccaaaacgagtcagggagttccagaagctcccattccggtgccagctgagaatccatttggataataacggagtaaaaactctggtttggagaaagtttctgtaatgtttttctttttcctttttggtggaagggagaataaaggaggatattgcctggtaagcatgcaaagaaaaaaagtcacgccaatttcactagaattgcccagaacctcaactctggtgaactgcaggtgacaacacttcacactgtttacatgattggggcttccctggaaactgcgctgaccctgagatgattgaacatttagagtaaaacccttgatgtagttcataaaattggattcaaatgaaaagtttaatgtggagtcattcaaaaataacactaagagctcttccctgaattcaaaagaaaaaggaaggaaaacatgttagtcttagcaggagccaaggctgcaggtgggggaagatggagaggacagtgtttgggttttattatgtttacttttctcttacggaagaatagaagatggatgacttgatgcctgaggtaattcagtatgtttcaccaatttggagatggtcatttgtccatacttaagtctcagtaattatgttgaaatattataatttctgtaagctgggaaggttacaatgtggtggttgtcattgcccgggcatgcacaaacttggtcgtgattcctggtggcatgattagacagacaactgcaaccccttgacacttaattccagaaatcatttaagaatcacttgaaaaaggaatatattattgttctccttccaataaccaagtgtcttctgaaaacctttcattgtcactttctggtaattgaacaatgagaacacatggacacaggaaggggaacatcacacactgggaactgttgtgg

SEQ ID NO: 3206 - DNA, 3211 bp, Homo sapiens
caatgtgtacactttttataaaaaccaccctccaaggaccaggcactggccctctctccggtgcccacagacatccacacaggcccaaagaatcagggattgcacaagccagagcaatcgaacggttctgagtcatctgccggaagccttgccctcaatcaaggcggacgtgaagcatctacaaaggaggaatagtcaaagcagcagcggcggcggcggcggcggcagcagcagcagcagcaggaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattatgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatcttctttctgtcactatagattaatttgcatttttaaagaaatttacatacatggaaccatacatcatctatgctttgtagtatgactcctgtcactcagtacaattattttgagattcatttatgttattgtatgtatcaatagttcatcccttttattggtaagtaacatttttttgtataggtataccatgatttgttgatgaacaaatttacctgttgatgaacatttacgttgttaccaagatttttgctattgaaaataaagtttttatgaatatttatatatata

SEQ ID NO: 3207 - DNA, 14821 bp, Homo sapiens
gtcaaaggtcactgagggagtgtattcagtagagaccgcgagacagacggctgtcatgtccttttcccgcagattcaaaatggtgaacagaaagcctacgtcttgaaaaacaagcagctgacagggccaacaaagggggtcatctatcttgaaatagatgtgatttttaatgctgtaagtcttaactttggcttttttgtactgctaaagagttcagtttcatgaaagcttttgttcctgatttgtagagaatttctgtcattcctcattttctctaaaccttcatgtgtcctggagaatacgcttctgccactgcctggcacacccacactttctgttatagttggcgaatgctgctgcggttgtgttctggccgctgtctaccggcataagaaagggaagcgcatgcatgtgcaactgtatacatttatattttatgagcacagcagccaggactttgaaactttagaaattattgcaaattgaactgcgtgaaaaacttgtaaacatttgtaatatattaatccataacagacacatatgttgatgtataggtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggtatgatcatactgtattacttacattgttattcattaaattcagtaatcatagctgcatgtttctgtggctatagtaacagttatgttgatgtggccattttaaaactcctattttaagacttgactggacagatttgccgtgggcaggaacctgatggattgtacaaggtctgagtctaagaatacattttcccccctcagatttccggaacgcaagacatctcagccaatgtatcattttctctgtgacagttaaaaagtaaaattttacatattgcataattccaaaccccaataggacagccaagaaaagtcctccatgtgaaaaataataatagtaataatctcgaccattctcaatttgattttatctgtcctatagttaatttttttcaagatatgaaaatcattggtagtagaatgctaccaatgctacttggtaatgctttaacatgtgattcaactggaagtggatgtgacctatttaagagatgttttattatttctgagatttctagcttttaaaagtcacaagtgagaattcgatagatccaaagagtcctttaatatgttcatcttgtggccttttactttgattatttaaaaacttctgatgagaccaactggcagagctagaaaatccaaaagaatactttgctctgagctttagctgggattttcttctctcacattattttggctttttcaggatttcagtttgaagtttaagtagagtcattcttttgaaatcctttattttattttcatgtttgttcaaatatgagtaccttatgcttccttatagttgccagtttagcagaatacgactttattatgggggcttacaagaagagccttaattatagtaacaaatcaacattttagtattaccattcaaatgagtgtatgcacatctgtttagtactttgagctctgtcttcctctcaggccttgtatgggactttcattaatgtctgagcacatggaacaaagagtgtctacgtccctttgtgttgtaagttaccagaaagttaggcagcctgcttcccatagacgtgttgttgtctccctaaagaaagcaattgtcattatcgttaagttttagaaaaaaaatctctctctctctgtctctctcagtattctttttgtagctctttcttataataaatatatggtggtactattaagcaaactttattctgatttttccctagccaggaggtacttttacattgatgagaaaaaatgatactgagcttctatgtctattttagactattacttccaggttttatggggtcatataacagatgcaaaaaaaaattgtcctgtaaagatcgtgctgccatttttgattcactccttccaaaatcattcctcacagctatttgtaaaatttgaaaagaccagaaatgcatataattgtattatttgttcagcaacattcattttgaacactttagcatttacgtgtattgtgtaagtcttcataaacttctgacttctggaggtcactcgcgtaaaatgaaattcaagatggcagccttttttttgcaatttccttttgattctaaaaaaaaaaaactcaggcactggaattctgaacaacttaggtacatttacatgatattacttgagtgatttgactgtaagactgtaagggggtcaaatttcactggagaagaaatgtaataatagttctcttagctggtagtcagtgtctgatggattcagtcctgtgaaacacaagctgaatgcaagaggcttgcaaaaaaaaaaaaaaagagggaatcaggcatagtaaaggtgggaaggggcctgctgacacggatggtgaaaaaagagaacacaaactacaatgtgaaaacagagtaagagtactttggagaagaacccataatattacctgtgtttcgctggaaaaaagaagctctgaatcacattctgttgaatgtgattaaaacaactaataacaaaatcaaatgtcatttattagacctgcactgggagttctataagaatgggaaccctgcctttttagcctagtactccagcttcatctgcacagtatctagcacttagtaagctcccagtataaatagctgacagaatcagttgaccaatctatgaaccaatcagttaatctgaaattttttcttatgtggagaaactcattcttcaatgatgccagataaataagggtttgctctaaggaagctagttattaaatcatgataaacatagcttagtactattgtagcaaattttcctggcgtttccatttatattctaaactacttcataattccttatcaatcattgattctaacctctgattaagttctaatataaaaatatccttccacaataatgacaaaaacaaccactaatatttgttaagcacttactatgtgtcaaggaactgttttacatgcattagcgaatttcatattcccaacaaccttatgaagtagatagtgttagttttccaatatacagaaggaagaaactgaggcacagaaaggttaagtagcttgcccaaggccacacagcagatattatttcctttctaaaagagcttttaaaatacatataccttgtaattttaatatcacagcagctctgaacaaaaactacttgggatatttattcatcttgtagatattaagttatatatttaaaaatgaaatgtttcaaagatttcattgtataactagagacattttagccctgtttattgaaaagaacagctttccattaggagaagggtgtgagcagtatcccattattacaaacacattgttcccatcatgccctgttgatggatcatgggtctattatcataatatcggttctacttggcccacttttttataaatgccactgcctcacagagcacaggcatttctatcattatgtggcttggttttaggcccaagtcagtaaactttataatgtttaagtgccttttttctattctattttaacttttcttttctactttactatccaaaaataaatgtagaataatgaaataaaagtaaaaaacaatcttttttttttcttaatccctatgtcaattgaagtagagagcacaagaaatgcaggcttaggacagctccagcttccttaacgctacctctgtgccacagggaagagtcaaagccagctgatgatattagagacaggcattggtctggaaggtgatggataaaatataagcagatacgtttctgggcgtgtgcttattttgtgtgcaatgcattcggttttaaaattttactgtgaatattgtctgcctaagaatgaacacagacatgtgtggtgcagaaggcactgctcgtcttggggaatcatctattgtagacatggaaatgtctcataaattgggcctaattttcatcaggctcttgactagacatttgtgttcttgtggatgtcagtgggtgcaacatgggggaagaaagagtgcacattttctctttcttttcagtactgtcatttctcactgtaatgagcacaaaaataattggacaactgagctatcagtaaaaggacacacttcagtgtgcgtcaaagaattattttacaggacaaactttaatctttaaatgtgattgtagataatttgtggtaccatctgtccatttggaattgttttagccttttctgtcgttatacagtaagtgctgctgtgtttaacattaacatttgatattttacacatttaatttctgttctgctgtgtagtccttggggaacggagcgctagtgctacatgagagagacaaagtattgatcagttaacatttcagctacatttatgtatgtcgcaaaattaatgaaaatgccagacaaaaatgtcagagtgcacaaaaaggtagaatttaaatttggtactttaatgaaacatcttaagatgtgcattatcaaaaatgtcctcttgcctttaaagtacaattcctaacagaataactaaagggagatacatattttacttagaggaacaatgaacatgaattatgaagggatgtcaactcctcaaagtaccttgtgttccaaaaacggcatgtttgaatgtttaactgttagtcataaaatacatttctttctgttcatatctggagggctactggcttcagccctctgtcctgagcagcctacgaggcaggtttcctactgagattctctccctaggttttccttggtattcatgtgttccttttgtgtcaaaaccaagaattccttctatggcaattcatcgaagccactctggttcattatttgtttttttctgggtccttttgaaatgcctagttttcctttgcttccagataatttgtgctccacctttattcaatccctattttagtaaaggatcatattcgggacaacagttactcccagaaagctgggccattatgcagaagagagaaaaaacaaagatgttgtatgcaaagaatgacatgaggcagctctgtatagccaaatgattaaaaaaaaaaaagtggaggaagcacagcaaaggaggaggaactggagttgcagaggcaatgggaatgtaataatgaccaaagacaataggctcctacagtacacttatcatgtacttccttctcgtgcagaaagtctgctgctattaaacaacatatggatttttaaaaagttattacaaaccgtaaggacatctaaagtgtctttcgtgatcaaggatcaaaaagggagaattgcttaagaagaagtatcaatgtgaaaacaaaggcatgtctacatcacctgtagtttaagtcttaatattcacattaaggcacaatgaaatgtaggataattacattgaacatattgaaggtcactttaagtttataacagaaatatctattctgaaaatttaagagacaatagtactaccacagcaatgaaattacgcttcaagtctatggcaattttcaaatgatttttatagaagagtttttgttgttattgctacaatttttttttagcgctagcagaaacgttagaaatgttctagatgtaacttttgttactttctacacaacagcaaaagagaagtactcctgaaaaccagagaaacaagtacaaagccaaaatgatctacaattggtggtcttactgtcatattcatgaatttccctaaaattttgtaaatataaactcctaagcctttttgcccatctttcttcatgtatgtttcctctgacatacacacctactaagcttactaaacaatacttccaatttaatctatacagatttagaagctacgttaaacattttctcacaaatgtgcaagtaagggaagaagaaaacctatataaaatttcactgatttaaaagatatatatttttaaggttgccctaacttccttttgcagagtcaagaagtattgacacttagaagtttctcgtaccacaattttcttttcagtaaatagattgtgcacccaattcatctggacatgctagtacatcaaattgctactcaaaatatacattttcgcccaatttatctcaactccggagaagaaatttttttcaaacattgtccaaaattacatgaaaaattgtaaattaggttttcctaagcattgcctttcatagtgcattacatataaattcctgcaattatataaaaggcccccaaagagtataaggtacaaatgagctgggtttcaggtttggtcactattggctaaaatcaaccctgaatcttaggaaatatagcaagccagataataacagaaccaaatattttctgtaatctttcctgaggagtgaggctctagttcagtttgtgggcctatttaattgtgaagttatttttgttttgtttttgtatctgctaagtccacagtgcaacacttggctcaaatcagtgcttcattctctttaaatgatgccaatgcccttttttgtttattttaatagatgtcagcaaaagggctttctgctctttggagggagataatcacataagccacagggtctgctactctctgaaaggcgtatttctcctagattttatttcatatttacaagaagaagaatttaatccctgtagaggtcattttctcatgaaatgaggaaactcatgtttcctatgatcgctgctcttccgcctttgtcctgtaacgtggaaagtagtagaatgctataattttgaaaacttttcttctgtgagtgatttgaggaaaagaaaatgatttcattttttctcaggtatagtgctattatgctatgctatagtcaaaaaattacaaatatcaccagcataattatgataccatattgaatctaagaattagctttctcatgtgcctcaatggtgctatcaataaaagttggcgtggtggaggacaccaaagcctcggtgtgtttttcctggctgtatggatgctgccccacttcacttcaagcttcctccttgcattacttatctggtagtttcagccccccagacctttataagaccctttaaaaattgttacatggtcaatattttacaactgagttgactaaggatcaaaaaattattaaataatgaatcagagatgtctcactacctgttcccagattcctaaaccaatgttcttgtcttctgaaggattttctactttgcaattgtgatttcaatcgtaaaggacagacatgctgagcaaattggcaagccatattccattgcaacatattatgaaataaagtactttgcaaaggaaaaagtttaaataaatgatctaattatataatttatgttagtaaaatgttgtaaagtaggaataataactcttctgaagggttgtaaattataacagagattcagtcattaatatgctttagtcattaagttcactctccatgtgttttcattccccgttctatcaggtaaaaattaagaaataggagcagaatgctttctgttgtccaattttcctgtgttgactagatgtgcagatattcgttacaattatgaatgtgttcgttaatttaccaagcaagaagctaacctgaaatgttaaggaagttgttcccattttactttgccccttctcttgccatcatttatcacattttaaattgtagtgagaattgggatagacacagcaggctttgctacaggtgggtctgtgagtgatgactctggtgcatcttgtactttgccgtgatgacagaggtccaacactcagcaagtggtaacactgagagatcaataacagagtagtcatcagctattggctcaaatagctgaaataacgaagagaaaatcagagaaaactaagaggcaaggaaagacagaaagcatatcaaagtgcaaatagatatttggatttgataaatcaaagtcagctctcattttaaggacaggaataaaatattttagagacaaagtgtggcctttatttgatcttaaatcagtgtttctctatattttttttttcatagtcactgccctaaggagaaaaatttcacttgagagaaattaaatactaagggataagattttctcaggggatattgagctttagagggccacaaacatctaagatttctgttgcttcccccccgccccagctcaagaaccagtttttacccccttggatgtcacattgaccccactgtgaatgcatgctccaaatgagggttaatacaagttcaactacatttacttttatactcttggtggtaaagtttagtttggattttctgtagttcgcatatgatatgaattattcccatacggaacttgtctggagaaagagcatttgtgatctttatgcaaaattattaactatattatagtccaattaaaggacaggtgtttgtttggctttatagagatcgaagaattttatcttctctcttatgcaaacccatatgagggttttcttctctgtcccaattccaagggtgcactgttggagaagtccagaagtccacatgaatttggactaagtaagataacttctgtcattatgagggtttgatgggttttatccagacattgcactgtatttataactaatagttactctttatatttttaatgaatattatgtcagagatataaacatatatttccttaggtttcgttacctattagatcttcattggaagtgttggggaagggagaaaggatttataataggagagtgatttaaaacagtgaagataattgttctactggctgttttgcatggcaagttacccagttcaccataggtcaaaaaaaattttactattgtcatttaccaataatatgtaaatatattatgttttatatcccatgtagctatatataaataatcttaatgcattttccatagttaaatcattctatacagttcctgccaagcatgcttcaggcaactctaaatgttcgaaacaagaatttttcatccagtgttgtcataaaatgtcagcaaattaaacaatactccccttagtcaattaatctttttgattgaacttaaaataatagatcaccaaggttaaaaggagtgcattaattaccacaaattaatatactggttgtatacgagaagtgttatattttgacgtgatgttagtagagtgatgggtagcactcagaaaagtaattcataaatgtagaagttcagatagctacattttcttcttctagttaggcagcaacattgaaaacttaaagagtgtcagtatgtatctggttttgtttaaattcttttcgttttgctttcattatgtttaattaacacaaaataatcgtacatatttatggcatatagtgtgatatttccatacatgtatacaatgtgtaatgataaaatcagagtaattagcataagcagcacctcgaacatttatcatttctttgtgttgggaacattcaaaatcttctacctatttgaaaatatacaataagttgttgctaattatagtcaccatatgcgggtattgaacacaaaacatattcctcctatctagctatacttttgtatgtgttaacttctggctctaccctgtcccccactgcccttctcagctaaatttttttaaatagagttttgttcttctatggcaagagcctattgcgtgcctcaaccaagaggctggtattttaagagagccctttaacctaggttctactagcttaactgagtgtgcactttttccttcattttttaattctcagagtatcagacttctaccacagttttatttctgtcttaaatcttggctgatatgtagttaaaatggaatgtttaacatatagactccaaacctccaaacaaaatgtagaggtctgtttggtaagacagatgcttagaccttggaacacatttctccacagtgggaatgtcatagatcatgacatagaatcatgtacaaagcctactagctgtagaatggaaacatcacatggagaaagtagattcagtggaatcctggcttggtgtttggaatgccagaacacatctaacccaaacccagcttcaggatagtgcaccttcctaatgcaaagataaggagcctaaaaggtggagattgtgtgggcttttaatggtgcagatgaagtcatggaatggtacaactggaatggaggttagagattattttacaggacaggagactgaagtgttaagaggtaaaatgacttactaacatagtaactctccttttcccccaatgactagtaatggaagcttcaaagacagcaacaatgagaagaaaggtgaagtttgtaagttaaattgtccttaattaagggaagccaggtgtctgacattgtcctgtagaattccaagagtgtaaaattggactcctggtccttggtatttcctgttaaggaatgtattgatctgggaaggctagaattgccgacttgatataataagtctgtatgcaccctgcttagtgttattcctgcagtttaagtaataaatgtgtaccttatgttttgatgaacttttctattagtggaaatcacatcacactatagctccacaaaacactgcagagatgtgtgtatggtaatcacgaactcttgaagagttcactgtgtgtttaagtaaggcatattttagacaagaaatatcatttggcctccaagtagtataaatgacgcttttcccaaaagtaaatgtcgactcattaagaatatatttcccaggtttcaaatatatattttcagtgagttgcttaaacagcttaaactacctatattgatctatattgattaaatggtagctaagatgaacctgtccgtggcctaaattttcattagactaaataaatgccaggaaaaagtgtatgtatttgaattacttagaaaaactggtgacccagcttcattgtatcgctgtctttctaaattgcctttaaaattatatggatccaaattattccagcgtaaaattaaacaacataatggaacagcatattcctttacaaagtagtggcagtactgaaataataatttgggcatattttgagatgatatttgaatttggaaggtgttgcccactttgttatttaaattatgtgaggtatagtttgctatacatttggtgcacagttttattgttattggagatactggagtgaagaaagataaatcatctgtatgaaatgctttgacatccttaagcagaaggacctgtggataatttagacttgaataatatttggccacaacaacataggtttctgtttctgagaactacacagtccttcaaagtttgtatcagtatgaaaaagtatttaacttaaaattattattagataatattctagactggatttaagaataggagataattcacaagaaaaaatgttccatcagtgtttgtcacaaatgcatggctctccaaaggcactgaaggcatatttaataagacttgggttctgtttctaattggctggaatgtatgacctaagtttaaggaactagaaaatacaacagattataaacggaaaaatgccattcatcagtatttttaatccattaccagagccagtgacaggaaataaactcaggctgttctgctcaagatgcatttcacttgccattaagaggacttccctcgttttcatgcacactcaataaagctgtgttgagtggctgactcagatgacttcagcagcaaaacttgaagttaaagctatactattgtaagagaaacccccaacagtagtagcagatgaagctgagaataaatgtggtgtatcaggcatcataaaagggtgaatgggggatacatttatgtcctcctctgtctgctgtgagatccatacataagattcacactcattattctcatcatcttaatgagatcagtgtgggaacatctctctcctttctctcttgactgtcagaaatgggttattccattatttctccttcctctctctgcttttaagggactagttatattttcttgaaaggccagaaatgttaactggttgcagcaggcagccccagagtgttgcatataaaggcttaaggacttttggtagaggccacaacattagtctctctcttgctcttactttctttttctctcagaaatgcttttatttcctttttgacttttgttatttgctgtatttcccaaggtgtttccctagaaaataagagaaaggataatttatccatctttcctgtataaagtacctgagtaatacctctgattgctatcacccttctcatcgggtttgctgctgtaattattttttttttacacagtcttcctaaaccaagtctgaatgcaattagttcacatgtccatgccatgcacaagcccagccttgaactcaaagaggtaaacttggcaagagaccaacttctaatgcattttatcctcaaataaatttccagatatgtcaagaaacagtcaatgtttacaattaaagctgctaagagattttttttattgtgtttgtagatggcgaatttccttaatcctcaaggacaataaccagaaattatggaaatatgatttaagtgatctaggtctattgatgattatatcgtaaccacactgtttttggaaatgctttcctttatagaagagaaatgttagaggattccctttaacatgattgaagaattttagagtaggcatttttaatatttgctgccctcttaattattacttgtttaatgcaccactgttagcacagggattatgagttaataaaaatgtcatagtgttagtgtataaaacactatataattttccccaggtaacgattaacagcataaggctatattaacaatattcttagtgtacagttcctaaatgtatttgattctcatcttttaaaaagtaattttacactgaaattcagtaataaaatattgagagatttagtgaagctagctcatggaaacttcttaggtgtgtgaattttttccggtggtttatattatattgttatgtaaaatatcattctattttaaaattaatctgagagttttaaatgttgtcttaacattcatcagagaaacgttattgagattcacaaagagcttgtttatctcatcatggtgtttgttaaagcagttgaaaaataacattaacaagccattaagtcacgattacgtcatggttttgttcacatagataataggtttccttttccctctttcttcttaaataatgtctttctggctttgttccggggctgcagcaggctgttagtatgtatctttataccatcagaatgaatgagatatatctgtataaattattgattcacttgagcctacctcggtaattcagagctgaaaactctggcagcttatctaatagaatgatataactagcagactgaagttacctaccacagcaacaattgccagttggggggtcaaatgccctttgacctttatacctgaacacctgcaaattgagctgtatcccattcagaattttaagaacaggttcattgtcacaggaagtagagtttgtttcttggagaaaattatgccagttctagttctgaatgaaggacaaggcctttattactcaagggatattagggctgactgcttttttgagaaaacaaatttgctgtaactttatctgtaatttagtcctgaatgggtgcaaatagactgcacattgtatggagcagaaagaagaaaataggggtttgttaaagccatgtaagggctatgtaaccattatatttccgagggaagtcttatcagagttgcgggttataagggggaatattttggttacatccttagtatcaaacacctgtttagagttttagtttagaatgacattggaaaagaacatttttctgtctgaaattgtggatgatgaaacacccatctcctgaaagttactaggtaggctttgacatggagactgccccatccagaaaccacagaaatgattcaagtctctacatgagattgaatgctaggcttagacctagtcggactatgttgatttgtttcacttttatagaaaatcagattcatagctttatatactctttccaattaaaaaataaatcctatgaaatattatttgcataagaatttgatttaagctttgccaatgctgaaagtaagatgaatgttttgagtaagggagtagaaaaagcatacttaccctgatgagcctccggatcacacagtatggggactaatgggtcatatatttttatttatttattggagaaactcatccctcaagttggtcacctactccttagtcagcgagctcggtaattgtcatagaaacactcatttttacagtgttatagttgatcactgacatggaaccagactaggtaatcaaacatcttagccatatgcttgttctaagttccaacctagtcaattagcacattttctattaaaaacttggttgtaataggtcttcattagccagcagttgccataattgaatagttactcaattattccattccccaacctcattttcacttcttgtcagactctaagtaggaatatttccaagaacattcatgatccccacctcaagcaaaattcatgacccgtacctcaaacaagctgttagaggttgatccagg

SEQ ID NO: 3208 - DNA, 3983 bp, Homo sapiens
gttggtagaaccgaagaatgtggaactcatggacacagaggaccaactgtagttaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcagggccctgactgaagactgtctggcaggtggaacggtccttgtcctctccagccaggcccagcaggcactaccttcatgaagtctccagcaaacctcttcctcacaagtgtctgtcatctgagtccaaagaaagctgaaggggtgggtttgttttgggggtactgtgcaaagctaatgatctggttggacttctacacttggccaaatgtactggctccagacatgacatttggtttgggggccctttgaagttgatgccaagaaggagtgaacacttctcagttgcccctggcttttccctcctttcagccaccacccacacaatgaacaaaagggaagggcccatttctgggggagtctggctgcctcttggctacgaaggctggcactgagcacccatcctgctccctctgcctgagctgagctgcctttcaggaagctctggtttagaaggggaaagatgtcatatgctcagttcaaataatcaacccaactgtgtccagagtgtccagtgtcatgagtgacccacgcacacacacagccattgctaaggtactcctgtgctgtttataagtctgagtgggaggaccctattgaatcctgtggggtcagaaactgcttggctgacatttattttctctgtgcgccttgaagctgattatatggcttgggagttcttagcttctgtgtataggaccagtgcatgcaggccagaaaccactcctgtaggactggctttccagccactgagggacttggaaccactccatggccttctcttttttttttttttttttttttttttttttttttttgcactgaagagtttctgtgaaggagccccagagttgggcatgtgccagaatcaggccaacaccagccacacctgtccacagtgccccttcctgctccagttgatccagagagctcctccctctaccctcatgatgccagggagcgtgactgtgggtgtgtctctgactgggacacccaggatagggtgtgcgatgaggccaggaccctcctaaaccctaacagcatcctaacgaggcccattgcagctttcgatttccttcataacagagctcgcaggccctcagttgcagagctctctcaccttctggagtgactccatcgttactccagtctttctaggtggtggaactctccaccacacatgccatttagaaagacgccagcttggcctttccaaaaagttaaccagtcgtctccccaccacaaaccctgtgggagcaggttactcttaggatgcacacccgtcaacgaggccattgcatttttttgcaggcatgaacggctcccatctaggcactaacccaggagccaaacaactgctggggagagttcagggcagctctttgggcggtgcctccagctgcagctttgccttgccacctggagccagcacgcctctgcccgacccaaggaggatgccatcactagatcctattttttttttttttttttaactcttgaatctgaatagttcctgccgtggggagaggtattgttcagggaaaatgtgatcgggattttagtgtggctgtaaacacagtcttcccgaaaggcttactgacgtttgaatgtgcaaatggtatgacgaaagatgtagggctctttcgttgaacttctctacggcgggcgggcggacacgtgttccaggtggacttgcctgccggccaggctttgagtctgaacttcctctaactgcagctgggctcctggcacacgcggtgccctggcatgatggtcctccctggccaggagcgagtcctaaggaaattcattccattgaccggactcctcccatgataggcccatggcttctctgctggccttagttcttggcccttcagattccctggggatataaggcccaagcggatctccctgcagccagccagcagacagcccagggtttccgcccaaagtgccctcatgttgcagtccactttgtgcatggaagatattgaacacaatttccactgctcttcctgcagggcctcctttccagcagtcacttgctcagactgaggggtgcacctcccctgccattgacaggtcctgcgccttcaggatgggctatttcaagcccgttttaagtggctcttacacaggctcagcaacctctgtggcctgcaggatgggccttctgctgtctctttcctttcttaaaaccttaaggtctttctagagacctattcaattttctttttttttttttttcactacaatgtcatgacaactgcagcaatttgtgttactttccaagatgacaatttgacattaattaagggaaaaaataaaaaggtgagctagatgacttaaaatgcatctcttttttgaaaaagctgtagctggcaagtcaaagtttattttatgtgtgtaaattcccagttgagcatttttttcatttggattagcgtgagaggaaaaatgtgaaatgtctcaaatcaaatgcttccttctaaagattagacattgcccaaccctgcccccgcccccaatcaatcagtgacagaagagaccgccatcagccaactagctttttttaaatggctgatatattcatctctaaaggccctcaaagcactgtaaaacttttaaaactttagcctttatgtcagattagagaaaccaaacaatgtgacggtacatgtgatgaaaagctctgggtttatttttctcccgcttatgaacatgtatttttatttgccgaatgaaaatcgtggtgtgttgctttgatgaatggaatttcaggctctccctgtgcacagccggtgggcaaaggtcaccttaaatgactttttctccctatctgtctgttaatccccagaccggttgcattttccagttgcttcctgggtgtctgtacatagtttgtctttgtataggagtgagtgtggtgaccgtcaatcccctaatctcccaggttctaatttaacagatgatggctgtatgaggaaaacgatgtaaatagagaatacaaattaaactggatctctgtggcctaggttttgtacatacagaaactgcatggtatttaaattattgtttgtctctgatgatgtatgcagtttctttaaaaacaaaccaaaaaaaagtaaaaaaaaaaaaaaaaaaattcttgactcttgtgtgttttgttatcaaccagcagcagaaaccaccaaaaatgctttgactgggaaagggaggttgcaggaatgggagaggtcagctcatctgcaaaatacatagtgagagtgagtggacatacgggacaaccgcatgtctcctctggtattattggg

SEQ ID NO: 3209 - DNA, 2648 bp, Homo sapiens
aatttacaaaccagatgaaagtatctccaaatgccataatgcattggctcatttctattaattacttcctggaagaaaaatcattcttcttagagtaaaaggacatcaacttctctgagcaccaagatactgcctaggttcccttccaggatattgactcaggagacttcattgtgaagaaatgtttactaacaaaactggaagccaatgtagaatacactaatttttgcaggaaggagtttccagtctctttttcaaggatttttttaagatacagctggaccaaaggtatgtctacatgtttacatcatttcttcttcttcttttttttttggtctggaaagattcccctttccatagtctccaaggaaggccctctagtctttccagattggttctgtttggattttgtgattcataaacagaagggaagggaaaagagaagacaagagtgaggatcatgagctagagccaaagatgtttctcctgaagccattggcttgtattgaggtattgatttataaatggcaagtacatgggagatacttttttgaaaatggtcttaaaaaaaaatgaaactgagtttattagtttacccctttataatgttgaataattgtgagttaaaaaaaaacaaaacaaaacaaatacaaacttgagttcatttaatattacatttgctggttaacctttttctttgattagactttcctcgatttgtttctttgactaagacattgaccttactgaaaactcctttatgtgtctttatagtcctgactattttaaatattgtttactgaagacatcgtgggtcagagagtgaaataaagaggaggtgaactaaatgtgcatgatagtcccttcacataagtcctgattctgtacataagtcatttaaatcatatatctagtacagtagccactggccatgtgtggcaattaaactcttgaaatgcatataccaagttcaaattgagacgtgctctaagtgcaaaatacacttaagattttcaagacttagtataaaaaatataggatatctctattcattttaacaactttattgagatataaatcatatgttgcatacttcacccatttctaatacattttcaatgttgactacctgttgaaatggtagtatttcttatacattgggttaaagtatattgaaacttcaccttttctttttacattttaatctgactactagaaagtttaaaaaatgtggctcacattatatttccattggatagcactgacttagataatggcttgtgaatatataacttcttgaagaaaatgcaaccaaagtatcctttgaccaatcaatcaatatgtatttttttcaaagttaggaattctatgagtctgcttcttttcttctattcaccaaaaaaggcatcaggtgacatctctctccctctgggttagttagaaaatgagcttggtgggtttagcttagcaaaagtaggggaagaaaaatagtataatctctatttttcaaagactttaaatgacgtaagctcatgtcaacatgtatttatgtcagctaatttctcttaggtgatcatagctaacttgctgtgttgtcttgttcaaacgtttcaaaccaggttctggtagcactctttgaatacacctttctattctatgaactgaatgttgcaaacctgtcacagagtcatagataagtagccttgcaaaggaactttcaaaatcaactccttccacttacttttagctattctactttcaccaagtaagaatcataagcctctcagaacggcagattatagaagaggtcttaaagatgttgtaatgcgaccccttcatattacgaatatgtgaaccaaggccaagagaagagagagcattgcaaagagtactcggtaagttagtcagactagaactaaggcttccttagtcgttgttcatttctcatattcccaaatcttgctgttgagcagaatcccatgaatattaaaacagctgtggctgggcacggtggctcacacctgtaatcccagcattttgggaagctgaggtgggcagatcgcttgaggtcaggaattcgagatcagcctgaccaacatggcaaaaccctgtttctattaaaaatataaaaattagcgtggtggcatgcgccagtagtcccaactacttaggagactgaggcaggagaatcgcttgagctagggagacggaggttgtagtgagccaagatcgcgccactgcactccagactgggtgacagagtcagactctgcctcaagaaaaataccaaaaatgcacatacgcagctgtacagaacaccccaaacctatcgaattagagattccaggggtggagactaggaatgtatattttttcaggtccctgggtcattttaaggtcttctgatgggctgattgttggaaatcaccgacttctacttgggattccgccctcaaatgtgtcacaattaaattctagtgtaggcattcttagtaagaactcttgattttcacatctggtttaaggcagagtggtttactgttgccttctgagacaaatccaagaaagtagaaactgtcaatacattgcatagaaatggcttattttcatgcatccctgatccttgacaaattttagttaaagcaggc

SEQ ID NO: 3210 - DNA, 4221 bp, Homo sapiens
ttttagtccatttatgtttaaggttaatattgatatgtgaggttttgttaggtatattactattaaataagtttatgggaaggtttttttttgttttttgtttctttttgagatggagtcttgctctgtctcccaggctggagtgcagtggtgcgatcttggcctactgcaaactccacctcctgggttcaagcgattctcctgcctcagcctcctgagtagccgggattacaggtgtgtgccaccacgcccagctaatttttgtgtttttagtagagacggggtttcgccatgttggccaggctggtctcaaactcgtaacctcaagtgatccacccacctcagcctcccaaagtgctgggatgacagacgtgagccaccatgcctggtcatgttttctgtttttttttaagacagggtctcactctgttgcccaggcaggagtgcagtgtcacagtcatgactcactgcagcctcaacctcctgggctccagcaatcctcctccttcctcagcctctagagtagctgggaccaaaggtgtacgccaccacacctagcttatttattttttgtagggacagggtctggatctgttgcttaggctggtctctaactcctgtccttaagcgatccttcctcctggctttcctgaagtgttgggattacaggagagagccactgcccctggcctcatttacattttaaaagacccctctggctaccttgtggagaactgagtgttccctggggtcagagtgaaagcctggtgactagcaagggggccggagcggggccggggccgtggctgggctgcagggccgcagtgggaatggagatggagaggaggtggcaggatttgggactgtccttgaggttactcattcaccattgttcccagcacagactgcagcgcctggcacattgcaggtgtggattgagtgcctggaaaagctgcaagctggtttgggcctctgtgtagggggaatgggctgagctcagcagttggtgtcaggctcctgacacgtgccatctggtttggtgaaagtctatgccgtcaagacatgctggtttggggtgagccacactggtttggagcttccgatctgtcttcatttggttcccttttgctctgtagtatctgtgcagtggcagagcagtagaacccagggttagggatggaggtaggtgcaggaggggtggccttagaggagaggtggatccaggggtgccccctcccagttctctgttcaggtctgtattgaccctcgggattggaggccctcttctcatccatcgtggtggcctccatacaggtgaatctcagcgatcccaaacagaagtatgagccatcagaccagagccatgtggactgcgtgtgtcccatccaaagggcacagcctctgatctgctgtacccgattttcttttttctttttaaggtggagtcttgctgtgtcgcccaggctggagtgcagtagcacaatcttggctcactgcaacctccacctcccaggttcaagcgattctcctgcctcagcctcccgagtagctgggactacaggctcctaccacacctggctaatttttgtatctttaatagagacagggttttacctatttgccaggctggtctcgaactcgtgaccttacgatccgcccgcctcggcctcccgaagtgttgcgattacaggcgtgagccaccgcgcctggcccactgtacctgattttctgtgaagtcagaggcctgattttcaggtgtgggcaagttggacattttttaacgtgctgcatgggcaacagaacatatctacgagccccattctgttcttgggtccccactgtttccctcctgatccagttgaaccccaggtgacagatcttccacaacagatgggtgatgagaaaaggagggatacttgggggctttgccatcactggggacccatcatccccagtgatgccaaatgaggccgattgtggcccggtgggcatggcctgggcaatcagggctcaagaccatcaagctacgcacgatgggcctaggagaagatactgatgctgtttttctttctctctgcccagtctgaagaaaggaaaagaatagatgaattgattgaaagtgggaaggaagaaggaatgaagatgagcaccaaggaaccacgtttgtggagtgagggaacgttctagagctggcctgtagtgacggttgcacagctgtatacacttcataaaacccatcagcctgtacatgtaaaattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccccgggccccaagcacgggccgggcatagatttcctcttccacaagctgccgcttttctgggcaccttgaagcatcagggcgtgaaatcaaactagatgtgggcagggagagggttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggttt

SEQ ID NO: 3211 - DNA, 706 bp, Homo sapiens
caatgctttatgattcttatgttattttttctttgtgattgactctttcctattccctcctcttctcttaacaggtaaatattgtcacagctctaagtttagtaatgtttcctatgtttacacttgctggaataacaaaaatagcgcagctacagtgctagtgatcagccacatccatgcttgtaaacctcagttctggtctcttctctcctccttaagctgtgtcttctgctttttgcccagccacattgttgattctgcctctcctacttaataaatggtcgctgtacatcaaagatggtaaattcagagatggtggatgtgctgtttccaaatcaaagcttgtgaaagtcattgctactctttctttcttgatgaatatggacttgaagatttctctatacaacgcacccaaatatgtgttctttactcttgtcttttcccaaatactgtattttaacatgaatttgcacatgtaaatccatggtggactcattcaggaagatccatcttaagaaaaacaaaaagcaaaataaaaacaagcaagtatgaagaggagttaccagtttgtcaaagtgcatcctcctagaagtttagtacctcaaaatttcctctagataatcattcctacccatttttttgttcgtttttttgagaaggagtctcactctatagcccagtctggagtgcaatggcatgatctcgg

SEQ ID NO: 3212 - DNA, 1798 bp, Homo sapiens
ccctgagtcgctgggtgcagagccagaggaacgccagcgaccccagcagcgctgcggacggtgctggccgtggccgctgcggcccccgtgtccaggtgggccaggacgcagcctctgggcgccgtcgcttttccagcatcgcagaggcaaaagcgtggcagtgggacccaaaagtggcctcagcctgagcctgcctcacaaccagtctctgcgggccagcaacgtgattctccttgacctgtctgggaacggcctgcgagagcttccagtgaccttctttgcccacctgcagaagcttgaggtcctgaacgtgctacgcaaccccttgtctcgtgtggatggggcgctggccgcccgctgtgaccttgacctgcaggccgactgcaactgtgccctggagtcctggcacgacatccgccgagacaactgctctggccagaagcctctgctctgctgggacacaaccagctcccagcacaacctctctgccttcctggaggtcagctgcgcccctggcctggcctctgcaactatcggggcagtggtggtcagcgggtgcctgcttcttggacttgccatcgctggccctgtgctggcctggagactctggcgatgccgagtggccagaagccgggagctgaacaaaccctgggctgctcaggatgggcccaagcccggtttaggcttgcagccacggtacggcagccggagcgcccccaagccccaagtggccgtgccatcctgcccctccactcccgactatgagaacatgtttgtgggccagccagcagccgagcaccagtgggatgaacaaggggctcacccttcagaggacaatgacttttacatcaactacaaggacatcgacctggcttcccagcctgtctactgtaacctgcagtcactgggccaggccccaatggatgaagaggagtacgtgatccccgggcactgagcctaagatgtcctaacctccacccagaaccccttcagtccctgctgggtgactcagggcgtcctaacgcctccatggcctcagtttccccatctgaagaatgggtacaggaaaggattgtccttgaggccccaggaagctctgccgccccctccctgtccctcatgccgctcctcagctccctcagctcctagagggggaagaggagagacccccaacaaggggacaggacggtcactgtgccaatcctgtcatcaccctcctgtggatgtacaggcagtgctcaataaatgcttcgaggctgatgaggctgctggctcagggtgcgtgggttcctcaaggtggggatttctgagttctaagaccaagtctccatctgagactcccaaattgctccccacctcccatccctgtttttttttgttgttgttgtttgtttgtttgtttttgaaactgagtgtcactctgtcacccaggctggagtgcaatgctgcggtctcagctcactgcaacctccgcctcctgggttcaagtgattctcctgcctcagcctcctgagtagctgggattacagcacccgccaccatgccgagctaatttttgtatttataatagagatggggtttcgccatgttggccaggctggtctcgaactcctgacctcaagcgatctgcccgcctcggcctcctgaagtgctgggattacaggcgtggccactgcgcccaggcacattcctcccttctgcccctctcagggccccttcccaggtccctgatctccaggcttggcctccagagcagcccacaccaaccccaaaataaaaaaatgtatatattccttta

SEQ ID NO: 3213 - DNA, 10216 bp, Homo sapiens
gagaaacccactgacgacccttctaattgttatgatcactacccaattgtatcagtgtcattgttcactaacccagtgcctagcatggtgccaggcacatagttactctaagaaagcacagtgattgctggattctctttctccttgtacagctcttcatgtggatgtctgagctcatatcaggtgtctgaaagaggcagattctgaggatttgggtcatgatggctgccaaagcttctactcctgacttaaagggcaacaatcctaggagaccaccagcacttacatccctggtaggacatgacacctgcttatggctcagaagtgacaaaagagaattatcaggatggcagtccttataaccagatgcttatcaacattcttcactacattctgaagatgaatttctacaagggaaattgtttatggaggcagcagatggctgaaattctgatccgatgtggctggttaatgcatgatctgaaaacccctgcactggtgattttgggacagatctagaatataccaataaatatattaacataccaagtagtctaggagcagccactgggcgaacaccaaaccttgcatccctgctgctgtctctgagctcagcagacacgtctttgcagaagagttctataatggtggtacaatggtgccccctcgtgacagaagcttgaactacagcttgaacatcgtgtgacatgatgaatgaatttattgagccccaggaagaaggaaaattaaagaagagcaaagaataatagctggacagaagatgggggtcattgaacctatatcctagttgccagaccagtaaactgaccatgggacctgggggaggcagcagatgaccgaaaacctggagtgatgtggctgaataccgcatgatctgaagactgcactggtggctgcggtatgggtccaaatttttccttaacaaaaacaaaaaaagagcccaaaaccatactgactagtccaggaatagccattaggcaaacaactttttgctaccctggtgttaccgatttctgaactcaacaggtgaattcaaagatatgcctgtctttccagcatggggagctggatttgggtcagctcaggcgcatgatgttgaacagctcttatgagcttctgatagtgcccaggaagtacagaaacaactgtctacaaatctttgaactcaaggcatatcacagggacatttgctttcttcaactagatatctgttttctcataaagagaaacaatgagaaatggtttttcacaatgcctcgttagccctgaggctcagccatcccctagtgctgtgtcccaacatttaaaggccgttgaagtcccactctatgccatatactctgtacaggttttctcatttacccctcaggacagcactgtaaggatggtgtggtcagtcccatttcatagatgaccaaactcaggctttcagagcctaagtcacttctccagataggtggtaggattgaaatgaggttccatccctcatcatccatagacagccctgagtagcctcccttttagaagatgggcttccagggcttgagaaatggtcagattccacccccctgctattgtggaccaatgcgtcctcactccacaacccctctgggtgatgaagaagatagagaagattaaatcccaccatttatgccaagagacctgggtgtagggccacatgagttggttgcttctcgaagtggtgagtgggctcaggcagaagctcaagtgttggccttgggacaggtgagctggagagaaggaaagtaacatacactaaactactgtaagaaaatgcactttatatttcatctcctttaatcttaactgctattcaaggtacctatcactttgacaattattcaaatcagggtactttaggaaagtttatgtaaagcagggaataaactcttttctctccagttcagcagctaactctagaattacttttaagtatttttaagtatttttccatttttttcttgatatctccaggactctcaatgcttgaatttttctcaaggccgacagtacacacgccctaaggtgttcttcactagtatttctttttaaattacaatctatatatatcttattcatattattgaagttgaaaacacattctaaatgaaaataacactaagaatgtctgtaaaataacggggaaacattttcaaactacatctcagatgttggattagtatccataatttatagggcaaactcagtaacaaaacagttggcaactaattttgacatagaattccaatagatatagacatgaacaaggaacttgttgattatgctaaaactataagaactaataagatgctaatataaatcctcagaagaatattaagtggaaaagacagcttgcaaaaggagatgattaatgtggttgcactttttggcaaagattacgtgcatatgtaggtgaacatggtcatgtgcacctcatccacagaaacatgtctggaaagtgtgcaccattctatggacaacagaccttttgggtcaggaggtaggagttgagctactgagaggtgaagattaattacaattcatatatgtgcttttgtatattgtctgaaatttggtattcaggaataaaaatattttgatgaatatttagacacaacataacatacatttgcacagattgacaaaagtaatgtgtattatgttcattaatttgaaatagctattactgtattctatttaatggtgaaggaagtagttaagtagaaggacacaaaacaagtctcaacaaatttaaaaaatcaaaatcatatcaagtatgttctcagacaaaaatgtaataaaagtagaaatcaataacaagaggaacctgggaaactgtacaaatatgtggaaaataaacaaacagcatgctccagaatgaccactgagtcaagaaaaaaaatatggaggatatcaaaaagttatttgaaacaaatgaaaatggaaacacaacataccaaaatctatgggatacagcaaaagcagtgcttagagaaaaatttgtagcaatagatgcctacatcaaaaaagtaaaaagattccaaataaccaatctaactgttcacctcaaggaactaaaaaaggaaaaaccaaatcccaaatgagtagaaggaaggaaacagtaaaggtcagagccaaactaaacaaaatagaaactaaaaatatacaaaattttaatgaaacaaaaagttagatttctgaaaagataaaaaattgataaaccatcagctagactaaccaagaaaaaaaagagagaagacacaaataaacaacatcagaaatgaaaaaggagacactacaactgataacatggaaatacaaataatcatcagagactattataaacaattatataccaccaaattggaaagcctagaggaaatagataaattcctggacgtataccacctaccaagattgaatcaggaagaaatagaaaacctgaacagaccaatagtaagtaatgagattgaatcagtaataaaaattttccaacagagaaaagcccagacctggatggtttctctgatgaattctaccaaaccttcaaaggagaactaacaaaagttatattcaaactactgaaaaaaaattgaagaggagagaattctccctaactcattttatgagggcagcattattatgatattaaaaaccagacaaggactcaacaacaacaaaaaactacaggccaataaccctgatgaaaatagatgcaaaagttctcaacaaaatactagcaacctgaatccaacagcacatcaaaaagataatatgccgtgatcaagtgggatttataccagggatgcaaagatggttcaacatatgcaaatcaacaaacataatacattacatcaacagaatgaaggacaaaaaccatatgattatctcaaccaatccataaaaagcatttgataaaattcatcatcccttcatgataaaaactctcaagaaactaggcatcaaaagaacgtaactcaaaataataaaaaccatatatgataaactcagggctaacatcataatgaatggggaaaagctgaaaccatttcatctaagaactggaacaagacaagggtcttgttttttcaccttcatcactactattcaacatagtactggaagacctagccagagcaatcagacaagagaaataacagatatccaagttggatatctttacatttgttcctctttgcaaatgatataattttatatctagaaaaacctaatgactccatcaaaaccctcccaaatttgataaatacaatatagttttaggatagaacatcaatatacaaaaatcagtagtgtttgtatgcaccaatgacgaaatagctgatgatgaaatagtggagaaagaaattaaaaaggcatgcctacttgaaatagctaccaaaaaaaaaacctaggaataaatttaaccaagtaggtgaaagacctctacaaggaaaactacacaacactgatgaaagaaattgaagaggacacaagcaaatggaaagatatcctatgctcatggcctggaagaattaatatagttaaaatgaccatactgtcaaaggtaatctgcagattcaatgcaatccttatcaaagtaccaatgacattttttgcagaaatagaaaaaacaatcctaaaattgatatgcaaccacaaaggaacccggataaccaaaccaatccagaccaaaaagaacaaagctggaggcatcacactacttgacttcaaaatatattacaaggctatggtaatcaaaacagcatggtattggtatgaaaacagacacaaagaccaatggaacagaatagagaacgcagaaataaatccacatgtttacagacaaaactgattttcaacaaaggcaccaagaacgtacgttggagaaaggacatcctcctcaataaatggtattgggaaaattggatatgcatatgcagaagaatgaaactgcatctctgtctctcatcatatacagacatcaactcaagatcaattaaagacttaaatgtaagatctgaaactataaaagtactagacaaaaacctgggggaaacactttagtacattggtctaggcaaatattttatggctaagaccttaaaagcacagacaacaaaaccgaaaatagacaaatgaccaatatgtgtgtccaccacagagtccagggcctttcctctgcaacaccttgtcagcgtcagtactttcttcattcctctgtagcctttctcacctccctatacttggggagtctaaatggcactactttatgagtgtctgtagagcaatacttatcaaggcctacataggcacacacgctttgtgctagcatttccttttatatgtttatcttcaggacttagtgaagaatgttgattaaaatctggttacaagtactgccatcctgatatttcccttttttcacttttgggcttgaatttagaaagggagacgaaatgagatgcaaagacacaagccagaaggaagtaaagggaaatgtggttgtcagcacacacatacactcacactctctctctcacacacacacactcactcctacatcaaccaggttctgttatcacaatactacaattctctcaacatagttgttgggctccaaggggacccattcagctcaccagagcaaatagccatgggaactctgccctggattacaaccactaccagtgcacagactctgaaaagatgctatccatgtcgtgtagataatagggaatattggaacactctgaataatatggggttgtgaaaattgattatgtcacatccacagtatgaaatttcagaagagagcaaaaatgagttatattgaaacaatgatgagagatgattttttttgcctatcagattagtaaagattcacattatttctaatatgagcagaaaggaactttcacactggaatattagtagtataatgcttttattaaaagtattttgatttcagataaatgcatgggggcaagatggcagataggaggcaggaccagcttgcagctcctgctgagatggacagagcagcatgtggagactcgtactgtaaacctttgctccaagaagtactgcaggaacataccaggaaagctgagagaatccacagaccctttgaagaaactggatcactgttgcaggccccctgagatgccgaaaaactgtgagtctgcttgctttgtcagtggggaagctggtggtctgggacaagttctcagccctggtcactggttgccctgaaatagactcggtgctgttgtagggcacagtgggaatgacaccagcctttagggctgcaggctgcatgggagcagggtgaggcccatgaccgctgactttcccccacttgctggcaaactgtatggttcagcagaagcagccataatccccctgggaatataactccattggaccagacaccacacccccatcccccacagcagtcacagcaagccacacccaaggagaggctgagctcagccatgcctatccctgcccctaccgggtggtctttctctacacaccctggtagacaaagaccaaggtcataatctcttgggagttctatggccctgcccaccgcctgagaaatctgaatacttaaccagctgtccctagggaaagttggcatcctctctgcaggaccacaactgatgcactcttgaaatcaccacctcctagctggaggccaaccaacacaaaactagcacactaaaccaaaatacaaccaaggacccttacagagtccacttcactcccctgctacctccactggctgcaaaacctgaagatggatcacatcacaggactctttgcagacactccccagtaccagcccggagcccagtagctccactgggtggctagacccagaagagcaaaaacaatcatgacactttggccctcaggaagccgcatttataggggaagggggagaacaccacatcaagggagcaccccatgggacaaaagaatctgaacagcagctcttgaattccagatcttccctctgacatagtctacccaaatgagaaagagcgagaaaaaaatttctgctaatacgacaaaacaagtttctttaacacccccgaaacattgcactagctcaccagcaatggatccaaactaagatgaaatcttggaatagccagaaaaagaattcagaaggttgattattaagctaataaaagaggcagcagagaaagatgaagtccaacttaaataaatcaaaaacgtgatgcaggatatgaaaggaaaattattcagtgaaacagcataaattaaaaaaaaaacaattacaatttcgagaaatcggggaacatatagagaaatgcaaaacgcactggaaagtctcagcaatcaatcgaacaagcagaagaaagaacttcagagctcaaagacaggctttcaaattaacccaatccatcaaagacaaagaaaaaagaattttaggctgggtgtggtggctcacgcctgtaatcccagcactttgggaggccgaggcaggtggatcacgaggtcaggagatcgagaccatcctggcaaacacggtgaaaccctgtctctactaaaaatacaaaaaaaaaaaaaattagccgtcatagtggcaggtgcctgtagtcccagctactcaggaggctgaggcaggagaatggcgtgaacccgggaggtggagcttgcagtgagccaagatcgcgctactgcactctagcctgggcgacagagcaaaactccgtctcaaaaaaaaaaaaaaaaaaaaagaattgtaaaaaaaatgactaaagcatccaagaagtttgagactatgttaaatgtcgaaacctaagaataattagtgttcctaaggaagaagagaaatctaaaagtttggaaaacgtatttgagggaataatcaaagaaaacttccctggccttgctagagatctggagaaatacaagaagttcaaagaacacctgggaaattcattgcaaaaaagatcattgcctaggcacatagtcatcaagttatctaaagtcaagacaaaggaaagaatcctaagagctatgaggcaaaagcatcaggtaatctataaaggaaaacctatcagattaacagcagatttttcagcagaaaccctacaagctagaatgaatttgggtcctatttttagcctccttaagcaaaacaattatcagccacgaattttgtatccagagagaaactaagcttcataaatgaaggaaagatacagtctttcccagacaaacaaatgctgagagaattcactactactaagccagcagtacaagaactgctaaaaagagctctaaatattaaaataaatccttaaaatataccaaaatagaatctccctaaagcataaatctcacaggacctatatgacaataacacagtccaaaatatatgtatgtatgtatatatatatgcaggcaacaaatagcacaatgaataaaatagtacttcatctcagtactaacattgaatgtaaatagcctaaatgctccacttaaaagatacagaatggcagaatggataagaattcaccaacctagtttctgctgtcttcaggagattcacgtaacacataaggactcacataaacttaaggtaaagggatagaaaaatatattccatgcaaatggacaccaaaagtgagcaagagtagctattctcacatcagacaaaacaaactttaaggcaacagcagttaaaaaagacagagggacattatataatgataaaaggactagtccaacaggaaaatatcacaattctgaatatatatgcacctaacactggaccttttgatttataaaacagttactactagacctaagaaatgaaataaacggcaacacaataaaagtgggagactttaatacttcactgacagcactagacaggtcatcaagacagaaagtcaacaaagaaacaatgtacttaaactataccttataacaaatggacttaacagatatttacagaacagtctacccaacaactacagaatatatattctattcatcagtacatggaacattctccgagatagaccacatgaaaggccacaaaacaagtctcagtaaatttaagaaaatcgaaattatatcgagtactctctcagaccacaatggaataaaattggaaatcaactccaaaaggaaccttaaaaaccatgcaaatacatggaaattaaataacttgctcctgagtgatcgttgtgtcaacaatgaaatcaagatggaaatttaaaaattctttgaattgaaagataatagtgacacaacctatcaaaacctctgagatacagcaaaagcagtgctaacaggatagttcatagcattgaatgcctacatcaaaaagtctgaaagagcacaaatagacaatctaagatcatacctcatggaactagagaaacaagaacaatctaaacccaaacccaggagaagaaaagaaataacgaagatcagagcagaactaaatgaaattgaaacaaacaaaaacaatacaaaagataaatgaaacaaaaagctggttctttgaaaagataaataaaactgatagaccattagcaagattaaccaagaagagagaagtttcaaataagctcaattagaaatgaaatgggagatattacaactgatatcacagaaatacaaaagattattcaaggctactatgaacacgtttatgtgcataaactagaaaacttacaagagatggataaattcctggaaatatacaaccctcctagattaaaccaggaagagattgaaatagtaatacaaagattgccaataactaaaaaataagttcagaaccagacagattcacagctgaattctatcagacattcaaagaattggtaccaatcctattgacactattccaaaagatagaaaaagagagaatcctcccccaaatcattctatgaagccagtttcaccataatatcaaaaccagggaaggacataacaaaaaagaaagctacagaccaatatccctgatgaacatagatgcaaaaatcctcaagaaaatactaatgaaccaaattcaacaacatatcaaaaagaaaatccaccatgatcaagtgggtttcatgccattaatgcagggatgatttaatatacacaagtaataaatgtgatagagcacatacac

SEQ ID NO: 3214 - DNA, 5158 bp, Homo sapiens
ggacaattgtgcaggcccccaggactttcgccccgggccagcgccctgagtgcggagccgaggggagctcgagaggcgccttctgtttaccttttatggttaaaataacagcttagcaaagaagcgacttcagaagaagcgatttagtgaaatcgtctcaagctgccgcagctcagccagtttaatcacccccagagagccgaacaactgcgagcgcaatgggacacaaaatcatttttggtctcggaaagagggtcgtggtcccgcacggatgcgcttgttgggagaaaccttggagattcacggcaaggcgtaaagcctggggcttccaacggtgactacggcacagaggagagttactgagtgcctctggggaggagcagtagaaagggtccattggctgatctgcttgctctgtgcttcctcctggccacctggccatctcctgatgcctcggggatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggtaagagataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggatgttctataaaaatggcccagagtattttcaacaaagcgtgcttcatttgacacccagagtctgactttggattcgaactaaacccaggcaacaggcgaggcaggacagaggctgagtggaaaggtggtctggagccccttccctctccctgctgacctgggagtcgcaggcacccaccagctgccaagagaatccctggaccggctcttcctggatgggtccaagaattggacagctcagatggagtgagggcctattttccaacagctcttcgcagacccaagagcttggcacatttccgggttagggtggaatgggctttgcagggaagagggccccctgtgcacgcattccacagcctgtcggtcagaacttgctagttgcaggagacgggtgttacacgcagtcatcagacctcaccctcacagaggcacaaacccacatagttgtggacgcctgcagagactcaaatattgagaggacttctcctttttctctccctccagagctcccacgagctgatgcacccccaggcttcaaaccacctggaatgcacagctcagggaagctggtggatgcctagaggctgaaggacagggaactctccattattggggcaggactcagggaggacacttggggccatgtgtctggagagagggcataggttacaccctacagaataaagaagggacccaaagcctctttttgcctcccggaatcaaggccctgagggcagcaggatggtggcctgggtggggtcgtccaactaggtttgctaacctgaggggtcactgggcctggccacttctgtccctctggtggtggaacccagcacgtggttctgtagggacctttgtcagtgagcaagactgagatcgtcacaggagaaggtgcccttgctggctgccccagcaggcacccacctccctgccaggccaagccaggtgtcctcttgcagcttggccttgatgacctctgtttcttcctgggcaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttattttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctcccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtcttttttttttttttttttaaagctactgcttgactgttccttagaataaataaaggatattttataaattaca

SEQ ID NO: 3215 - DNA, 3367 bp, Homo sapiens
aggtgacttacggatccttgtgggattgagtcatgcttttcatactgcacagtcatgaagtttgccctttgtttagtagatgtagctgaactttgaaaaggggacctcgtcatctattgaaaactattagtagaaaagaaaagaaacctctttccttgtagctggctgcacacaaggtgagtaggccaggctgctgcactttttcgatcattccgccaattctggatgtctcactggatccaggactcagccactgtctttgctgctctctttgttcatgactactgcgtcaggtctgtattccatacctgctcatgccacaggcactggtggatcccttggacagtgaccttatgcagtgatgttgatcttactccccttgctgttcatgaaggcatatagattatttatttatttatttatttatttatttatttatttatttatttttgagatggagtctcgcactatcgcctgggctggagtgcagtggtgcaatcttggctcactgaaacttccgcctcccaggttcaagagattctcctgcctcagcctccctagtagctggggttacaggtgcctgccaccacgtccagctaatttttttttgtatttttagtagagacagggtttcaccatgttggccagactggtctcgaactcctgaccttgtgatctgcccgtctcagcttcccaaagtgctgggattacaggcatgagccaccgtgtccagccggcatatagataatttatataaaactggtgaaagtctagtaattttggagtttgtatttcaacgcccttgaaggtgttgacaaaggaaactgcagggcaaaggctgttaaattggaaactgaaaagtcactgtttgcagatcaagtcaaacaacagagtgactcattagtggagagcaaagttcaaaactctactgagtgtttgggaatgattgtgacacacaatttgctcagccttgagatctgcccttgtgtctttagggcccagatagaatcaccaggatgaccactgcaaggagggtttagaaaccaatcatttgctatgaagattatggaatcagagagagctcttggagatggtacagctctacctcttcattttctatctgaggaaaaagactcagagatacttgagatactaactgacacccccaaagccacaagctagtaagtggtagaactgggactttaacccatctcttctgaccctgcattcagtcagtttctttaagttgtgactaatagtcagatactttagtgagtatatttcatttatagacagatgccagtcaaaaaatccccactagtttacctgaatatttaactcaaaaaaagcaccttcgttgctggacctctataactgctgtcacatgttagtggccttaagtttacctgttgaagacctacagtctcaaagacaactgtctcaaaggtgacagtttgttggtagcactgataaaattgtattagaaattggctgtaatatctgcaatgttgtagaattttaaaaaataatccaaaggcagacagctctgaggaaataaatcccacctaccttggtggctttgtaaccttgtgtattaattgttctgaaaagtctgattttgaatctgtaaaatggagttgatacctaataacttcttatttctggggggcatgtgcggggaggattcaaggatgtaagtaagagctagcatattggctgctacaaagtagcagtttctttcctttatgagtctctgggactccatatttgttgcattaatcttctttgtcatatcaccaaccagtggtttctagcttttgtttcactactgcttaagggcagggtgttgtgacaggggaggattccctgtctcagtgtcagggtattctcttttggacagttctaatgttcgaagattttcatattgtgaaattctgctcccatgatatataagtactgcttcttaatcttctctctggagttacccaggataattctgaacccttttctacatagtatccctttaaatatttgagagcagttttgaagactatcttagtgactttcacactgttcttcaactgaaattatttctttggcagtcagtccaggctttgtcagagaagtggagctttaatgattttggtctgtatggctgattaaaatgggaacttaggttgcattggtgggcttcttcaggcttgttactactgcacagcacaggactaattgtcagaatgagtccttctccttgttccacagttctagccatatgtacaggcctacgctttgacgccagttctgaatctaagaagggagtttgcaaggagccattggatctgtccgaagttccattcttatcgttgttgccacaaatttctcaaacctcctgcctgaactgcgctcctggttggccagggtctttggcctaggtgtcagattcatgcttgcccagatcttgttgagctttctgacattttgttcccaaatctggcctgggttcttcactttggcctgaggaaatcgtcctggtgttaacctcttagttggcatcaacctatagttcatgcttttttctcctcattttcctgaatattttcaagccttctgcctggaactagccagctttttccccttcaagtcctctaacaaaatgctactgggagtatggtgagtcctgctctcagggcctggcaatggaattggctacttttctgttggagtaattaggttggcagttataaagaaagctagaaagacttggcatttttagcctgagacctctgactgtatggttaaggtgtgaggaaacgcatgcctttctagatcacttccatgtatattctctttcctccctgagggttttttttcttaattctctattcaggtcaggtttgcacttccttgtcctttttttcctctgtgctatctttgcaagtctgtagttgtatgatcaatctctagaactggaatccctgggttcaaggacatgagaatgtacatttcctatgattcttgccaaattgccctccatagattttgtaacaatttatactcttactaagaatatatgagtatatcttttcacgtaccttcactaatgttaggttttatcaaacttattcattctgccatgttatggcttaatttgcatttctttatactggagtaagattggcattttgttatgtttactggccttttgtatgtcttctgtgaactgactggccttgggatattttttttttaaagctctcaaggtgattaggatatgcagcaaagtttgagattagcaattgattagatatggggaaagctgattgtgtcaaagaagcttccaaactctgccattaacagacaaaaatac

SEQ ID NO: 3216 - DNA, 549 bp, Homo sapiens
aaaaaaaaaaagctatttgtgaggtaacaatctaaatatgtttgagctagtgcaacagtaagttaactccttacatctgttaattcagcaagcactaacaagtgatggagattaaaaaaaaaaaaggaatgagccacagctttgccatcaaagacttcagcgtctcttaggggaaacagatgtaagcaaataatgacacgatttagggcagagatatatcagaagatcagcttgcctgtgcgtgggggaaatgttagggaagtttgggttatccaggctacaatgtgtggaaagggatttcgcacatacaaacaacagagggccaagcgctggcccatgtctgtctccaagtctttgaaacatttctcacagcactagagaaaacacagtgtggttggacaagaccttgggaacatgggagctgggatcagaatgtgtctgtgtttggatgtcggagttgggcaacctcttggctcggatatttttctgttcgttttgtttaataatctttaaaataagcatgacaactaataacatttattggatatg

SEQ ID NO: 3217 - DNA, 2193 bp, Homo sapiens
gattgctgatcaagaaggaccctgcaaagctggagatggggtggagtggggcagtgctgcacatgggaagagcaacagactagaagccaggtctgtctggcactagtcctgacttcaccgcttctgagctgcgtgatgttgagtgagagtctttaacctccctggcctcagtttcctcattcaccaatcagtatgtaaccccttcccctcccttccttctagggttggcaactggatcaaatgacattagatttgaaaagactttaaaaagtataaaagacagtacatagatgggaagtcagtctttaagcctgctttggattttccagcatttcagctccagcaggaggagaaagatttactttctatttacttatcactgttaacaagcaaacacatacaagtcatatgggtgtgtgtgtgtgtgtgtaatcttttaacttttttaaaagtctgatttattgaaatatatttacatatagtaaaattcatccttcttatgtgtacagttctgagttttgacaaaaaatacaatcatgtaatccttaccacaattaagatagagaacacgagacatagaatacttccatgacctcttcacccccaaattccctcacacttctgtcatcaacccattcccctactcttagcccctggcaatattgacctgttttttgttcctattttctacaatgtcatatgaattgaatcatgttgcctttattgtttttagttctaaaaacaacattattgaggtataactgatatacaataaaatgcacatacaaaagtatacaacacgtaagtcttggttatgtatacatttgtgatatcatccccacaatcaggacagtgaacatatacccatcaccctaaaagtgtcctcaacttctactgtcactgcttttcagcaaactgatggttctctgcatgtactctgaggcacagtgctcactcccactgttatgccctccttcaggtggctttctttcccttaagctaccacctggcccttttgatctctccaaatcctgcccatccttcaagtctacgctttagccctccccaccacccaatgtctaaagggtcctttaaagttatcctttgagaataattcagcccacacttgctacttccttctctactcctaatgtacttacagacaacctctcattgtggtctttctttatataacagtgtttgtatcttactgtcctaaggtgagtggcccagtgtttagcagcatggtctctggggttagatagttaggttcatatagttaaccttaggctcctgtttaacctctgtctctgtgtcatttttccttatctgtaaaattaggaagacaatacagtatctaccacaaagggtcttgtgaggattaattgggtttatctgcataaagcacttagaaaagaatcttgttatacagtaagcacttaataaatgtccactggcttcatcagtaccattaccgttgaaagccttttaacagcaaaaactacaactctcactgtgtccacagtagtgggcttgtggatggagctcagatatttgttgggcttttgatcaagggaccattccagtgaatcagaaagttcctgtgaccacttaacatattacacgcttgcttgtgtactgctcttagatgatataaaaacaaatcaaattcccaaaccaaaaagctgcactcttttgtctgggtaaatacagctatgacatgtctatttccatggtttagaatatcaccagtgggaatctactgtggaaaattgagtacaacactatcatcatatgatttgttttgctcatatttggctgtgccattggctgcggagccaggcagcgaactccacacaatgaggagcctgtgaaaacgcagagaaggcaagaaaggatgcaaacatttaggcagcatctgatggtagctggcttgtggtttacctggcctttggttagataactgtgcctgatccctatggccaggaaggaaggagctgaagaattcacatttgggctgatgggcctggggtagggatgaccaacagaccacatgcttcttgtctcttctactccctgatcctctgatagacagggctaagtgatcatccactccttccaccctccagcctccgagtgggccacttttcaagcatggaattccaggttctgcaccctcggattcaaccaacc

SEQ ID NO: 3218 - DNA, 6340 bp, Homo sapiens
gcagcagacatggtgctaggactccacacgtcctctcagtaaatcccaggagacaggaccccagaggcattgctctcattcagtgctctcgcctccctcctggattgcctagtcagagtgagacatggagaggggctgatgtaaccaccccagcaggagtaaggaggctggaaggaggaaaccagtgatgaaggatttgccataaccttgtcctggatggagagccatggccaaagtgggtggagaggaatggccatgcaaggcagctgtgatggattcacctctgtgcaagacagctatgacggagttgatagaaagtgtgagaacatgggccacccctccttggatgttttctttccagattggaatggtgtgattctaagagtcctgggacagaaggagtattggaggtgtcaaggggctggaccggtgaggacaggagtcgaatgtgcccctgatctctgtccctctcctcggggctgcagcccttgtgacatcgaagtgccccaccccctccttcggcttccctcgctgctgcgcagaggccactggagggcgctgtctcctcacacttctggctgagctcacctccgctgtctgaacctccttttgaggctggagagaaattgagaggcctggagccagtgtctgggaggcctctggacacagctggacccaccgaggccacatggggtcagtaggatctgagcctgtggaaggaggtgccagagcaatgactaggagtcaaagtcctgggcttcagggcgagggcttgtggtgagctctggacaaatggctttgtctgttcgatcctcagtttttgtatctgcagactgtggagagtgacccaccttatggcactgttgtgagaagtgctacaaatgagaatgtacatgtgagtgcttcaaagaactcagatgttctccatgccagagtgggttttatttatttatttattttttgatggagtcttgctctgttgcccaggctggagtgtgcaatggtgcaatcttagctcactgcaacctctgcctcctgggttcaaggaattctcctgcctcagccttgccgagtagctgggattacaggtgcacaccaccacacccagctaatttttgtatttttagtagagatggggtttcaccatgttggccaggctggtctcaaactcctaaactcaaatgatccacctgcctaggcctcaaaaagtgctggaattacaggcatgagccatctcacctggctaatttttatattgttagtagagagagggtttcaccatgttgaccaggctggtctcaaactcctgaccccagatgatctgcccgcctctgcttcccaaagtgctgggattacaggcatgagccaccgtgcctgatccgccagagtaggtcttgatggttatcacccttgaagaatcatccagtaacccaaggagaagatcatttggctagggccccgtatgaccttcaaactggcataggcactgaactgttccttacgttctcacaacagccccaagaggtatgaattattatcatctccatttcatagctgggaaaacccaggctcagagaggcgccatagctccccctgggtcacccagccactgggtggccttaccggaattcagacccaggtctgtttggctccatagacttgcttaaactactggactgtcccgcactggcccatgccaagtcaggaaagggtttgatgtgacctactaaagtccctcgggctgaggtttcagctgagtgtcctttatttagtcctttggaggtgtggacccgtatgtctttggtatggatccacatttcagtggggtcagtaactccctggattggttttgccatttttttttctccccttggacttatacgcatgattcttccccctccctgggaagcagagctggccctgtgacataggtggctttacctgcagcttgacctctttacctcttttttttttttttttttttttgagatggagtctcactctgttgcccaggctggagtgcagtggtgcaatctcggctcactgcaacctctgcctcctaggttcaagtgattctcctgcctcagccttcccagtagctgggactacaggcgcacaccaccacacctggctaatttttgtgtttttagtagagatggcgtttcaccatgttggccaggctggtctcgaactcctgacctctctcaggcgatctggccgccttggcctcctaaattgctaggattacaggcatgagccacggcacccggcaaccttctcatatgagtggcagatgggtggaagaggctggacttatgtccattcacaggctccccaccctggtcagggtgcagggtatttgctgtgctggaggacatacctccatgttaaaatgcccagttgaagccttgtagcttttttcacttcttattttctatcttgatgaaagattgtgctgtcggcagggttgtagttaagtcgaagtgtggctttgttttcacaatttctgttcactttcctcccactcttaggcagcttgagaagggtggaggggtggggaaggagagtgacagtgggtgctggaatctcccagcctggggggttcttgaagttccacagtcatggaattgtggcgctggaagcgaccctcccagggcacagaggaggcaactgaggcccagggagaggacccagaccctcccaaggtcgcccagctagttagcgacaggctgggaccagaatctgcctttctgctggtcccacgccaacacatttgctaagtcacccaaagcctggagtgtggttagtttagaaaactgagacaaggagccaggggatgggacagtggagcggggacagggaggtgctgaccttgtgctttgaaagcgctagtggggagttgcttgtcttcatctgacgtcagcccctggacaaataatggccacagaaagcaaatattatgagagtccttgtgtaaacacggagctggtgtttcagtgtcagaaatgggccgaggactccaggctctatcagaccagctccccagcgctgcctctcagcaaatgtacctctccctgctggggaagaaggaccttcaacaaagatggggggcagagtccccctaagaggccacagtggggcagaaagggagaagctaggagggttctgggagaactgagaagatgcagcatacccagggactaaattagtttagggatgcaggaagaaaaacctgtcaattaccaggcacccatcctgtgtcaggcctgactgagccctttatagacattgtctcatttaatcttcccaggagctctaagggataggcattgttgtccacattttgtagataagtacattgaggctcagagaggttaagcaacttgtctgcagtcacacaggtgggaagtgatagaacggggatttgatctcaagtctgtctgagtccactaccctggtgtgttttgcagtctggaccaagggcctttcttcatcagagtcaccaggaaaccttgtcaaagaggagatacccaggccttgcaccagcctttggggagggcctgagagtgagcatctcccagggaagaggaaggaggaaggctgctaacacctgggaataatcgctcaatagcaggagcagctaaatttttccttaaagggctagatactaaatattttagactctgcagacctttagtctctgttgcaactatttggctctgttaccgttgtgtgaaagcagccacagacaatacgtatgtggatgagggtggatgcattccaacaaaactttatttacaaagtggcatgctggatttgtccctggtagtttgctgccccttgtctatagcatgcaaagtgcccccatagcctgtctctctggttgtcttcccagcagccctgtgaggagggtatgattttctccgttctacagatgaggagatggaggcccggggaggttagacatccagggtcccacagaaagtggatgtcagagctgggagtagaattagacctcctgatcccagttcagtgtgctggaaagtatgagcctggtaagaaggtctgggccagggagattgctattaagtaatgaaagcagccaccactcactgggtacttgccatgtgctgggcactgagtcatgacctcacataagctgctacccagatgttgaatgtcattgtctctgtcacatggggtggtcacagcctccctgggaggtaggaaggcatctgcagcatgtcaaaaccagcttatctcgggtgccccaatacacctgacatgttacagctgcaccacgggaaggtggaagctgctgacaagatgtatttgcctttccattcgtgagaatgtatgcattctctctctctctgtctctttttttctctctttttctctctcattcaaagacacacacacacacacacacacacacacacacacacacaccccagtctcaaacaaacatcaaatagacatgtggtcacttcagtgaccttcttgtcctaggtaggagaatacaaaacacaaggcctggaaatgactcgtctggtttacatgacatgtccctgctgagatcaggaaccgggaaactgcctggtatggggaaaagaatgctggacttccagttggcctggattccgtaccacagcctgaccctgatctgccgggtgactttaggtgtcactctcctcatttctaaaatggatgtcgctttcctaattcacaaattgggtgggaagtaggtttgttcatttgttcaaggcattcatttattcatccattcacttccaactatgtcgtaagcaccttcagtgtgctaaacacagctagatcatttgatttgaaactctaaagatttaagatgtgatccttcctacgcctgtttaagagttagtacttaaatgataggtcttttgactcaaggatgccttgtgctaggatttccctctaggtaaaaaatttatctttctcccatgcataaagtgggccttggcaggccaggtgcgatggctaatgcctgtaatcccagctctttggcaggctgaggtgggaggatcacttgagtccaggagtttgagtccagcctggtcaacatggtgagaccctatctctacaaacaaacaaacaaacaaaaaaattagccaggcatggtggtgaatgtctgtggtctcagctacatggtaggctgaggcaggaggcttgcttgaacccaggacgcagaggctgcagtgagccgtgtttgcaccactgcactccagcctaggtgacagagcaagacactgtctcagaacaaacaaacaaagtgggccttggcaagaatatattgccagctctgtgtgccaatttattcatccagtcttccatctatccattctgtccatccatccacccacccacccattcagccacccatccatccattcatccacccatccatccattcagccacccatccatccattcatccacccatccatccattcatccatctatccatccattcatccatccatccatccatccatccatccatccatccatccatttttccacatgaacccttgcatccctccatgcaatcatccatctattcaatccatccatttatccatccacgtatttattaatcacttctatgtgcctggctcaactctgtccactgactccaacctccaagaaggccctatgcccatagtcagcttgagtttgaggcagaggtgatggaaagctcagagtctaggtagcaataatttccgattctcagaatccaggaactctctgaaatgccttcaggcactttgagagtaagcggagccggagacagatccgttcaggctgcacacacctcccctgtttagatgaagcccttcctcttggttctgctctagcctctccctccgtgagaacacctgaagccccggccctggccctgtgtcaactaaaaagaatcctacatgaatgggtaaacaaactgtggcatatccatgcaacaaaatagtatacagctgtgaaaagtaatgaggcactgacacgtgcctcaccatggccgaaccttgcaaacactatgctaagtgaaaaaaaccagacacaaaagaccacgcattgcatgattccatttgtcaaaacaggcaaatccatagagacagaaaggagattagtggcggccgggggctgaggggaggaaagaatgagggatgattgctaaaggatacaggattcttttggagatgatgaaatgttctggaattagtagtgatggttgcacaacgttgcgaatagaaatcactggattgtatactttaaaagggtgaactgtatggaatataaattattt

SEQ ID NO: 3219 - DNA, 3922 bp, Homo sapiens
gctgcgcactggtcccgcccggccgggccggggaagagggcgcggcaggaacaggaagagcccggcgcaatcccaggtcccgacccgccccctgcgagcgcccgaggccggcgcgggaggaccctgcgcgctggacttcaccctggttccaggcacctccttcggtctccagggccggcaatgcgctggggagttgaaaagcgctgccttcctccaggctttcctggaaagaaacgcttcatggcagtcttgaagacagcagcctgcattctcagtctgggaacctactcctttagtccctgcttccagaggaagaaattctgaaagaattgcgtttgcctgttttgagcctgcgggttacctaaaggactgacacaagacattggtctttgctttccctaacttggaacagggcagagaggtgtctcttcagagggtattgctcaaaaaacttgtaaggcaaataatctgcagccacctggggcaaaagatttcagttgaagcaaacagacacaccaacagcctgagaggaaaagctgggagaaagtttcttttggaaatttgggcattcaacaatgtccacttatactaaggttaggaatttagaaagtcatgcatatatgcccagggcaggaagcatgctcagaaaagatctgaaaagaccctttagctgaactttcggctcagcacaagcaggaaatgaggctacagtagagttgtaaacagcagggctaagcaaccacagtgtcccccaacacagccattctgcaaagactgggagaaggtggttgtcctcctttctgtctactcttttttgggggatggtggagggaagctctaggtattcaaaaaagtctgtcaaaacactagtggtggctcagcctataatcccagtgactcaggtgggaggatcacttgagcaaaggagttcaaggctacagtgagttatgatgcccctgcactgtagcctgagtgacagagtgagaccccatctctaaaaaacaaaaaacaaagtgtcgggcgtggtagcttacgcctataatcccagcactttgagaggctgaggccagtggatcacctgaggtcaggagttcaagaccagcctggccaacatggcgaaaccccatctctactaaaaatacaaaaattagccaggcatagtggcacacaccactagtcccagctactcaggaggctgacgcaggagaattgcttgaacccgagaggtggaggttgcagtgagctgagatcgcgccactgcatcctggcctgggtgacagagcaagactccatctcaaaaaaacaaaaaacaaacaaacaaagcatcagctgaacacaggctaagaaagagactttagagaacaaacacaacaaagaacacagaatttagaaagagtttagaacactcactaaacaactacaactcatagcaaacaacaaaaactcagaaggaagggtctgatttccggagtcacattataatattcaaaacctccagttttcaacaaaatgttacaaagcatgtgaagaaataaaaacagtatggtacatacacaggagaaattaacacaaagagtctgagaagaagaacagacactggacttactagacaaagattttaaatcaactgtcttaaatgtgttcagtgagctaatggaaatgatggacaaagaacaagaagcctgggtaacatagcaagaccccctttctaaaaggaataaaaataaattagccaggcatggtggcacttctcccaagctacttgggaggctgaggtgggagaattacttgaccctgcaaggtcaaggctgcagtgagccatgattacaccactgctctccagcctgggcaatagagcaagaccctgtctcaaaaaaaaaaaaaaaaaaaaggaaaagaaaaaggaaaaagaatgacaagaaaccaggagaacaatgtctcaacaaacagaaaaccaacaaagagacagaaattataaaaaagaatcaaatagatatcctggagctgaaacatacaataactaaaacaaacaaaaaaaaaacttcactagaggatttcagtggcagatttgaactgatagaacaatcagccaacttgaagataggtcagttgaatttatccagtctgaagaacagaaagaaaaaagaaggaagggaaatcaacagagtctaagatgcctatggaacaccatcaagcataccaacatacatataactggagtcatagaggcaagagaggaaagggaaagaatatttgaagaaataatgacagaaaacttcccaaatttgatatgacacaaatctaaacatccaagaagctcaatacacttcaagaaaaataaagggatccacaccaagacattttgtaatcaaactgtcaaatgacaaaaagaatcttgaaagcagcaagaaagtagtgacttggataagcaccatggctcaagcctataatcccaacactttgggaggccaaggcaggaggatcacttgaatccaggagtttgagaccagcctgggaaacgtaaggagacctcatgtctacaaataatttaaaaattatccaagtgtgggggtacacgcctgtggtcccagctactcaggaggctgaggaaggaggatcagctgagcctgggaggtcaaggctgcaatgagccatgatcgcgccactggacttcagcctggggacaaaacaagaccaggcctcaaaaggaaaagaaagtggttcatcatgtaaaaggggtcctcgataagattaacagctgattgggaggccagggtgggcagatcacaatgtcaggagctcgagaccggcctgaccaacatggcgaaaccctgcctctactaaaactacaaaaattaggccgggcacgtggctcaagcctgtaatcccagcactttgggaagccgaggcgggcagatcacctgaggtcaagagttcgagaccagcctcaacatggagaaaccctgtctctactaaaaatacaaaattagccgggcatggtggtgcatgcctgtaatcccagctactcgggaggctgaggcaggagaattacttgaacctgggaggcagaggttgcggtgagccaagatcgcaccattgcactccagcctgggcaacaagagcgaagctccgtctcaaaaaaaaaaaaaaaaaaaaattagccaggtgtagtggcgcacacttgtaatcccagctactcaggaggctgaggcaggagaatcgcttgaacctgggagatggagtttgcagtaagccaagattgcgcccctgcactccagcctggcagacagtgtgagatgccatctccaaaaaaaaaaaaatttttaaattagcaaggtgcagtggtgtgtgcctatagtcccagctactcaggaggctgaggcaggaggatcacttgagcccaggagttcaaggctatagtgagctatgatcacaccactgcactccagcctgggcaacagagcaagaccctatctcttaaatttcagcactttgggaggctgaggtgggcaggtcatgaggtcaagagatcaagaccaacctggccaacatggtgaaaccctgactctactaaaaatacaaaaattagctgggcatggtggcacgcgcctatagtcccagctactcaggaggctgaggcaggagaatcacttgaacccagaaggcggaggttgcagtgagccgagttcgcaccactgcactccagcctggcaacggagctagactccatctccaaaaaaaagaaagaaagaaacaaaagaaaagaagaaagaactgtgaaaggacagaaaaacttataacttttagaaatatatatacacctaagaacagagcctcctgcaaaaggtgacagaattaaaaggagaaatagttcaaaaacagctggagtcttcgataccctacttcctttacttctttcttt

SEQ ID NO: 3220 - DNA, 434 bp, Homo sapiens
gtaggcgagccaccttgggcctatgtccgcatggtctccaggtcaaaattcacatcctactgattgaaggccttggtcttcagctgttgggttggcgtggtgtcaggccaggaggctgcagactatgactgcctgttgcagtgttgggaaacacacatgttaggaaacacatgtgcatgagggagacacacacacacacacacacacagccactcagcaatgtgtgtgtgcgcggtcggtctggcgccacacacagctccaagctgtttgcagagtgccactggtaaggtacattcatggaaacagaggtcactcatggaggccaacagaagcaaggcgtgcaagttgccacgcatgaaagaatggcactgaagtagtgaccagtggacctgggcctgtttctcaagcgtacatttgatttctttatacttctc

SEQ ID NO: 3221 - DNA, 1448 bp, Homo sapiens
gtgtgagccaccgcgcccagcccaaattgtataatcttgaattctcacaaattcgagatcttcccacgcacctctgtgtgtgtgtttgttttggtgtcccttaacactttccctgcttcatcacactgcccagagcttcccactgggaacatactctcacctccttaattcccatttcctttttcttacccaaacaggaaggagtagccactattcatgccattgtcaaaacctcatggcaacaaaacttccagggctggaattgcaaagatgattacaaaggggagctccacaatcaggtgttccaagataatgaatacttccatagcaacaaaagtctgacaataaacggttaccttgattttcacattttcaaagaaaaatccctcaatggcaactagaccagaagtctcaacactgaatatgcaataatggctacaaggtgaacagtttttctattccattttcttagcaacatcattgattgattttcttggaaaggaagttagattggattagatgatctttttgtttcagtcatgtagcttgttattagcaattaatatatgcagtagcttttgaaacaacataagtaataagtgacttcagtagaaattcattatattctaacacaaatgatttataaatgcaattttattttaaaatttctatcctttctgtctccctgattataattgtcaaagtattctgatagtagaaagtgtgtatgactgaaaaaatggtataaaatatttcagatatagtatatattctataggttgaattcaaaagactgctgtcactgtacattttttccctaacaaatcatcttttttctatgcataacctatggtgaggcaacattctttacattgtgttaaacaagaaaatactttgtaatgaattaaagttaaggaaagactacatctatcagccacaaggaacttgagttctggcaattttgagggtttaaggctcacagttttagcagctatgtctgcataaggacttgattggatcaaaataaagaacacaaacatgaacaaggggctccctgaaaattcagagcttcaatgagttcagcacaagtcctaaaaggacatctccctaaacattgacattaaacgtttttgcactggcttgactgggtataactttaaaatgaaatactaagtgaaatacctgtataatgaaaactataaaacactgacaaaagaaattgaaggggacaccaaaaaatggaaaaaattccatgtttatgaattagaagaatcaatattattaaaatgttcatattacccaaaacaatttagagattcaatgcaccctctatcaaaataccaacgacatttgtatcaatcacagtcctctagagggacagaatatgatatatatgtacatatatcctattatatatgtgtgtctatatcccattatatgtatactgt

SEQ ID NO: 3222 - DNA, 1421 bp, Homo sapiens
ttttttttggggtttataatgtggttcagatttctgtagaaattctggctgtatctacattgccttaaagtaatgggatatttttttttttctttttctttttttcttcagctggagttccactgttgtcgcccatgctggagtgcaacggtgtgatctcggctcactgtaacccctgcttcccaagttcaagtgattctcctagctcagcctcctgagtagctgggattacaagcacctgccacaatgcctgggtaatttttgaatttttagtagagatgggtcttaccatgttggccaggctggtctcgaactcctgacctcatgatctgcctgcctcagcctttcaaagtgttgggattacagtcatgagccaccgttcccagcctgtcttttctttccaaagccacccttggtgattaaatgttaaatatgtactagtggatattactttgctgaatattgcctagtgaatattaagtatttattctcacttacagacatgaacttgtgaattcaacaagtgaagatttacaacttgataaaccagctgcaggagtaaaggaagaatggtatgccagaatcactaaatgaagaaagatggtggatcagcttttctgcaaaaaaatttgctgaggccttggggagcgctgaggccttggggagcactgaagccaaggctctactgtaccaaaaatttgaaggccatgcgaatgatctgtatgtggaaggactaccagaaaacattcctttcagaagtccctcgtggtatggaatcgcaaggctggaaaacatcattcaagtgggcaatcgaattaaatttcttattaaaagtaactccagtcaaactccattgtctccaagtcgactttcgtcctcacccacaactcctccacacaagccctgaacatgtgtccatgtaagtgacatcctttatgtctttatttttgtatttgatttgatttgatttgattttgagtgcagtggcacaatcttggcttactgcaacccccaactcccgggttccagcatttctctgcctcagcctcctgagtagctgggattacaggcacccaccaccacacctggctaatttttgtatttttagtagagacgggggtttcaccatgttggccaggctggtcttgaactcttgacctcgtgatccacccgcctcagcctcccaaagtgctgggattacaggcgtgagccaccgtgcccggcccatgatttactatttataagaacatgggcttactacttgtgtaatacttatccctgtattttaggtgggagttgctgaggtttggtgactacatctggcctctcagggaaatggccaagttgttcacatctcacctgtataatgtgaagttgtttgtcagcttcattggttactactgtgaaatgagttataaagg

SEQ ID NO: 3223 - DNA, 3184 bp, Homo sapiens
agaagccagactgagaaagaaaagcataaaggacacgcaacagcatgatgcctgagcaaggaatgtggatggagaagggaatattggacaaggtcaggaccgccacttctagagaaatgtgataccgggacaagatatgactaaaaatgtctgcagagcagcagagagtgcctacctcaagttaagtaacatgaatttgcggtgaattcagtgcatttcataatactagagttattattaaaaagacactgtttattatttaattggttttgaattgtttcttatgaattaactttgtctctccaattataactttcttaggcaagaggacatttctgacataatgtttatatcttccattgcacttattacagtgctagcgatataacacatacccagcagaaggttgatagcatataaacaactacattttcaacttggcctttatgatgtccctgcttctggattttgtttagttcttctgctattttccaggtagaagtatgatagttgaactttattgtgctctagaaaaagcaataaacccttctgcaaacttcataagatagcacagtaaaaggaactctacaccaagaggacattttcccttcaaaataacaaagcagaacacaaagtaaatcaaagcatataaacggagaaaggaattccgttgcctttgaaattgaactccagaaataatttacttaaaaagagttcctcagatatagcttgaagtctaaagacaatcattgatcatcaactggtattctcttactccatcagcactccagatacaaagcaagagaaaacccagagtaaaaaatttaaatggacaatatttcatctgcaacctggaaagtcttctatgcttgctgttgtattgactttcctacttatctcagaaaattgtgcatttaatcatctctctctattttctttgactcttttccagtgagagagtataagattgtttacctaaagacctcgaagtctagcaagataggaagcaagttgttacttaagcaggttgggggggcattatgggcacaatgaaaattaatcattggttctctttgcctatcaaaatacatcgttcacataggacccctttccccaataaatttagatcatgcctactctagaaaaggaatcacagcattgtcacttcttgatgttgtgaagtaatttgtaatgcgcagaaatgatttgaatacatgtcccaacagagctttgtgaaggaaactcaaagctattctgacataatagcaaatgatagcagagaagggactgaagcactgcagcaaacccaaaattgttccaatattcagctgctagaacaaaaaagaaaagcctcactactgaacctttttcatttcgtatagctgctcaaaatttagaaaactcatagaccataatccattaaaacagcatctattacatcaagttctaattgctaaacttgctggtaaatccttggggtaaagagattggaactcttccattttcaataaagattatttgtaaaactaaaaaaaaatccatgagacaatctgatagatgtctcattattcctgatctgtgttcttttttatttcttagccctacctctacaaccgattaaaatgcttagcctaaatactttcaccatttcaaagaaaccactacaaaaagtgctattttttggccgggcgtggtggctcacgcctgtaatcccagcactttgggaggccaggcgggcggatcacgagatcaggagatcgagaccatcctagctaacacggtgaaaccctgtttctactaaaaaaatacaaaaacataattagccgggcgtggtggcaggtgcctgtagtcccagctactcgggaggctgaggcaggagaatggcgtgaacccggaaggcggagcctgcagtgagccgagcacgccactgcactccagcctgggcgacagagcgagactgtctcaaaaaaaaaaaaaaaaaaaaaaatgctgtttttttcctggattttatgaggataaaatttagataatcttttaaaaatatgtacaatataccaaactatttaaatagacattagcattttctgttaaagtactgacatagtatttgcaactattttttaaatcatttttctactcttgatcgtttatagtcagaatttcagtcaagtttagcactatccaaaaaaatcagacaggatgtgttgcttcacaaataagaagctacatgtaagtcctgaagcacaaggtttaaggaaaggatttcagcaatgacttattcagcagatactcatcatatttcctcttgtgagttctgttatatagtccatattcctatgcttagagcagggattattctgcctcattggccttaaactacatcagccctataacctctacttccccacaggtttcagtgatctcccaattctgtcgcagaaagcttttccaacaaagtacacatttatattacaaccacaccccatatgtcctccatgaactcttattaattctccaatacacatgccattttattgctctgtgaagtcttccatgttttttccacgcatgctttctctgctggcctctgtgtatacctctattatatcatatagttctgtgcttatcacgaatttttgataatgcatttctggcaataaaggagaataaaacagaccctccaaagagtttggatgaattagagcaaggtggcttaccatcagcataaaatttcttccttaaagattagtttaattttattttagatataggggtacatgtgcaggtttgttatatggaaatattgcatgatgctgaggtttggaatatagatcccaccaccaggtagtgagatgctaccaggtagtgatacagatgctcccaccaagtagtgagcacagtacgggttaagtagtttttcaacccatgtttccctccgccattcctcctctactagtctgcagtgtctattgttcccatgtttatatgcatgtgtgttcaatgtttagttcccacttataagtgagaacgtgtagtatttgcctttctgttcctgccttaattcacttaggaaaatgacctccaactgcatccatgttgctgcaaaggacatgatttcttgaaatcatatgttttatccggtaaaaataccttaaaatatttcatgctatgccattatgtgtcc

SEQ ID NO: 3224 - DNA, 4364 bp, Homo sapiens
caactcctccagggtggggcagtgcagagggggccctggccagccctagtctggggcatctgatggcaggaccaaccctccctcacaggacccagcccttgtcagggcccagcccacactggggttggtgcccgtctatccctgacaaggacactcacagtgacctccttcggacatgtttttcttcttgcctgtggatcaattcctcctggctcagacccctccaggactctggcactgatctctcttggtctcggatttgaggaaataaaaatagaagaggaaaaacacagaactctccaaagctttggagtggctgcagccatctggatggaggcagcatgcgcctgggctggaagagccacggtcccttgactgagtctcggtgcttctccccgtccctctcagacacggttctcatggtggacgagatggggccggatcttaggcccgggattctgcagaatgcaaggctcagagcttgcctagctctgagtggcttggagactggtgtgaggactgagggtgtccacagatcaccaacccacaccggcagcctgagttggaagacagacgtctcggaagagctggcttattcgggaagctccgaggaaccttgccttgtccagccttttgggcacccccactctttagctcacagtcgctccctccatcttcacagccagcactgaagcattccccactcgctctcattcagacctctgctcccaacagtcttgtcatctctctctctgaccgtctcacggaaaccctgtgatgacatggggctcacccacatatttcaggatagtctgctcatctcaagatcctgaactccatcgcacctgcaaagtcttttgtgcaaggtgtgatagaatcaaaaataaatatttggtcctgccacagagtttccaaaacccttggaatcccctcagcgggctgatgggagcatcgattgtcattcagaccaatcctctcctgaccatacctgagtttatgctaattaggtaacccttgaatggccaatggaatcaaccctccagagcgaaactctgtctcgaaaaaaaaaaaaaagaaagaaagaaagaaaaaagaaatgctgattagagggttagaactttcagccccacctcctgaccctggggaggggagagaggctgaaggttgatctaatcaccaatggcgaaagatttaatcagtcatgcatacccctccctgaaagaaggggttcagagagcttccaggttggtgaatgcgggttgattctgggaccaggaatgctgtttctgcagacagctgcagggctattccctaggcttcttgaggtctttgtccaaagtcacctttctcagagtcttctgacccctgttgacccctgagtctcctcctgaccatctcttttcccctgtcacttgctttctctccttaatactgattgtcacccaacgatggaatgccttacagaagactagagagcagcaactttgtctattttggtcactgtgtgtccccagttcccagcacagtgtttggcacacagcagagcttatttgacatgttttgatgaataaatgtcattgttgttaccaacaggctggaaatcaggacacgtgggctctgcccctcacagttgagtgaccctggggagggccttaaccctggtcttctgggcctcccactttcaggtcaaggttacagtcgggggcctgtgggtgggcttcatctgattggcccctttggtagtgctgggccgcatcttcgggtcatcagtgaaaagcgttctcaggtgtgcccaggagcacgtgcccccacagagcagtgaccttacctgctgaccctcatcccaaaccctgtagctgtttcctctgctctttttttcgttctggaaaaggaagtggctttaggaaggacattacgtgtgatgaatctgaccttggatgcatgtttgctcaaactcacatcattgtttaatgccacaggcaagtcactgagtaacagactaaataattcccaagaaaagtttatatatgtgtgtgtgtgtgtgcgtgcatgtgtgtgtgttggcagggggtatctgtgggggcgaaggtggagactgatggtgggtggtgactttggccacaatttgctccaaggtccacatccttgtacttgaccctcggtggtgcatatctaacacaattaaattatagaaatgctgggccaggtgtggtggctcatgcctataatcccagcactttgggaggccgaggtgggctgatcacctgaggttgggagctggagaccagcctgaccaacatggagaacccccatctctactaaaactacaaaattagccgggcatggtggcacatgcctgtaatgccagctactcaggaggcaggggcagcagaatcacttgaacccgggaggcagaagggttgcggtgagccaagattgcaccgttgcactccagcctgggcaacaagagcgaaactctgtctcgaaagaaaaaaaaagaaagaaagaaaaaagaaatgctgagtaaaaacggtttcgaatgctaaagccagcagagaaattacatatttgagctctgaccctttgtaacagaatccagatctgtggtatctctattttgggaggttttagcataagccatcttacacattccctctcaccaagagttaggcagcaatgtctttgtccttccaccttgcaaggtcactctgacctgtgggtgggtcacccagaggtgctgtgagtgggacagaaatagctgctctgagcaaatgcctttcccagcagtctctggggaggatgatactccagcttggcagagcccctccagccctgcaaacaagtgctggtctctgtttgacccttatttagcgtgtcgatgaaggaaggaatgacagatgacccaggccccaatcctggcctgtcctttgagtggtccctaaaataataccattagtggggccaggcacagcttcttatctgtggagtgggtgcactgataacactgagcaggtcctcacggaagccctgggtgaggaggggtagcagctgcgggccttggacatgttgcgaaggtcttcgcctcctggctggcctgctgatgttccaaggggtataaatagtccgacgggctccacgtctgattgtgcaggcatggcggcagcggcagagcctggcacacctggtatgtgacacccaaccaaagccacggtgcacaggcacctgctgctgcctctgccgccatgtcctcagccagagtgggccctgtgaactcctcctcccagccttgcccagccgtgacctccttgtccctgcttcagggacagggatattgaagggtgctcaccttcaatatcgtgccttaagcatttctgtggctgcccacagttcatcatcagaatgcttcttttgttcacatttattattcttggtcctagatttggaaataaagaacggcacacaggaaaaggtaaaaaaaaaaaaattgtccttaaatctgaccttctccttccactggatattagctatacttatttttagactttttttctatccatacttacattgttttgctgttgttttaatacaaaagggattatactcaatttttgtagccttctctcttcacttactgaataacaaatgtcatcctgggccccagacccccctgcagccccgtctttgatggctgcctggaccacctgcaggagaagcccctcagaagatgggtccctggaacctttgcgcaggtttgctgaacctcaggagttcactcagcacatcgttcgctctcagctgccccagcaggagctgcgcagaaccgccttggaggcgtgctcagaggacacttcctcacttttataatgaatcgtgagcactctctcctcgctttggccggcagagcctgcctttctggccacgtggacgtcttcatgcagggtcctgctggccccttgacatcaacaggcatgaagctgcagccatcctctcccctccccaagttttgggcaccaccatctcctagtctcttgagactggcccctggcttctcccgttaccccagcctcagtcccatccaatctgctccccattgagaagtccaagtggaccctcttctccggcctcactgcccccagcccactccttgggctccatcccagcctcttccttggcggtcccccagctactctccagtcctacgtgcagctgcatcttccagatccacctggcacggcatctccttctgcctcaatgcctgggattcaggaccttgatcacagctgggttttgtatagaaataaataaataaaactgaaagaaaaaaacacgaaatgttaatattgtttatatgaggttggtgggat

SEQ ID NO: 3225 - DNA, 8351 bp, Homo sapiens
cccccaccctgcccctgcgtcgcggcgcgtcgcgctgctgctcccgccccagccggggccgaagatggggcggcggctgcggttttccacacgacttccttggatctcggggcacacgcgccgatagttcggacgcgagtccgggctggttttgctccgttttactgcgtttgattactaatttaaaagctttgcgttccccgtcgccccggcccgcttttctcctgcattctcccctcggcccccgtccccgccctgcgatcgctggagggggcgtcggggctcgcgcgccagaacccggctcctccgaagccccctccgggccccaccgcccccctcgcgcctcccggcccccgcctcctccccttcgcccccacccaacggctgctgcttcgggcttcgcggctcaaaaacaacagcggaggcgccgccagctccgcgctccgccactgcccaggccggcgggcggcactcggacccgccgccctcggtccctcgcgaggccacggaggccaacacgcctcgcacggggggacagcgcgggggcagccgtccaaacaccaggcgtcctcggctggtcgtcccagggcgcccgcacctctccgcccgcgctctcctgccgccgcgcccccaagcccccaaactccgaggcgctgcggcggaggggccgggctgagcgcaggcagggtggcccgggcccaggagcctgacggcctgagtgcggatttctcatctgagtatctgggaatcgagaatgaattggaaggaaaccgaggcgctgccctggccaggttgctgccccgcacccttccggagcaccgaagtcctgcccggcaacgggacttggagctgccgcagagtcagcctgagcccgaggcaggggtcgcgcccgcgatgcggggtctctgcgccgccccgcgaggctcctggccttgccctccctgccctttgttgtgtaataagacctgtggcggctccactgagacccacacgtgcaactccgcgcctccgcgttaaaggaggtgaaacgcagcagccctgagaaaccccgagaccccggtgtcctagcagaggcgccccggatggggaggggcgcggggccggcgccaccccagaggaaaagcccagcggagccgggttgggcaggagctggcggcggcggtgcgctgggccttctgccttggatcctccgcggtcggcaccgcttccctgctcagattcgaacccagattcggctcccaaggctcccacggctccagggtgcccagtcttgcagccagctcgccgcccgagccccggatggaggaagcgctcactggccgctacctctgctgtttctggcaccagatgggcagcttccggggaccggcttgcacgatgccgtggccaccccagtggagaccctctgcccggctttgtgtcctggcgtccccaccagggtgcccagctctcctgcgcagatgtcgggagtatctggatgccccatgggcacttcgagggcccaatccggagttttttgttttgttttgttttaagagattgagactgtgaacctgaactcccttgatctcctcccgttgggcccaggagggagccgaatccaggcccaaccgggctcactgagaaggtgcaggaagcccccaacgactcctactcgtgtgcggcccatactgggccaggacgctgcagtggccgagccgctgggtgtctgcaacggggagctcccccgccgctgggggcaataaacggaatcggtttcacacgctttccctcttgatctaagaacctttaaaaatccgccaacgaatgctgttgcctggatgcgctgcctatgaccttcagccgtgtgttcacgcgcgcccgcagccgtggagtggcggtccctcctgccgcccgcaaccccggggccgccggtctgcgcacaccgggagcaacttcgttacccacagcgcccgcgtcctgcggctcgcgcggaactgcgcgcgggaaggtggcagagcgacgctccagaacgctgcttgcgtagacgctgccgctgccttcagatcccaattcggccgcgcgcgggcggggccctggcagcaacgaaaatggcgagcctcgtagccttccgggcccggcggccacattccgggagtcgccaggtgggagcccgccttccgtgtccccaaacgcccagagcccgggacacgggccggcggccgggtcaccaagccagttcccggaatcggctcgcgccggaatccagactcggcttgcaaagcccgctcctgccgtctctccgcagcgcgccctgccccccactgccggccctcttagcttcaaaaccaaattttgcctttcatcctgagagattaataccccgcaggtgaaaccgtggagacggagctgcggtgggtttcttttccacgcctcagtttcctcgtctgtgaaatgggaccaggcgcgcctgtgcttctccgggagtttattgcagggctggctggagagaatggctgggtggaagctgccaggaggaggcccaaggccgcccaccccgtgggcctcgtttgctgagcgggggtcagaggcgtgcgggacagggcgcgccccacggcggctctggaggcggcccggcccgtccctgtctcctcccctcgctccccctcccccggccttcccggaactctcctcgcccgctgggtggaggaggggcgagggccgactccgccgcccctggggtctccctcctcccacccccaccgcagagtctggcccgccctgggctttcctctcaggtccctttgggtctccagaagcccggaggtttcgcgcagactcgaacctgagatgacaccacccagcaccccaaatcctgcagagtgtggaggggatctggggagaaggcaggggctgcccgggcgctctggctgctgggggtgggggacagggcctgccggggaagcgggtcgggggaggactggagacccaggctcccctaggtacaacgaacctcgcgggagggaatacgccatccccgtacccacttccgaggacgtaggtcttttggcaccggcggcagccgcgttcccacacatctgggcggggccccgcagcatggcctggggagctgaggcttcgggatccggcacaaactaccattctaggtgtagacggaggaggtggggtgtgggaagcagggggccatggtctgagcagaccttctcacctctgggcctcccacctcctggggcaggacttacggggaaggacccgaggggagtggggtgtccatagggacacccaagggtctatccctgcgagctttgctttctactaaaccaataatcgcagtggtggtggcagtcgagacacggctcaaagagccggcaagaatagagcagagaccaggatcgccccaggcagggaaaaaatgaccagttctgtagagtgacccgaaggtgatggaatcactcgggcgtcctcctgggaaagagctgcctgctcccccgccgccgccagtacaccggcgcccatgccccgggggctggagagagcagccaggcacagcccctccagcttcctgggagtccaatttcccaaggtagaacggtggcggcagagcctggccctgtggtggggcagctgcaccccgatgagtggcttgcagttcctggagccctgcaggttgttggagaggcagggagcccttctccctcctgcctgccctcttgcacttcctctcccagaacccagcactactcccagaggctctgagctggagccctagaaggaggcgctgcaaggctccgtgctcctggagcttcgagtctatggtatgagttaaacagaagggtatctcctccatcagatctacaggagggtgtctgctccatcagacctggagcttccaaggcattttacccgaagctccagcacctggcccaaggctgggctgtgctgtgtcctcagtgaaagaatggatgagtcacagctgaatgactgaagagctgaaccaggtccagaaagactcagccactggagtctgtatttcctgagtcgcctctcactgctggagctgtttatcatcgctccaactttcactaaaaaggaaaaactatcacttaaacaaagccattgaaaccccagcatcatgtgtggattttttaacataaataaatcatacaaactaagatttatgttcttggaatgatgtcattcattgaaggctgccttcccaatcaaagccgtgtttagtgatttttctttagtgggtgtgctttttgctaaataggaaaaacccgttcggtcatccttgctgctgtcttttctcggtttggcccagaacatcagaaaggtttctccctgggccagtccacagagccaaatggtgaaaatggttttaactccacagactgcttttaaagcctttgctttggaaccgttaagtctgagatcaaaagactgttaaaccttccctaagaatgtgtgcaggcctcagcagaagtttatggtcctcccaggtctcccagagcctagaatgaatctcgctgcagagtaacgcatctgcagaagcttcaccaaattgaaatgagtgaggagcattaaaatcagcacacgtggataaataacaggtggcatatccatgcaatggaatactatgtcgccatgaaaaggaatgaagagctgacgcttgttacagcatgaatgaacctggaaaacatgacgctccgtgaaagaagtcagtcataaaaggtcacgctttgtgtgattccatttatacgagatgtccaggatgggccaatccatagagactgaagacatattagtggttgcctggctgtagaagtagaggcagtagtactctgggccaatgaaggccctgggaacagatgggccacaccagagtccagcttcagccctccaggcattgaaaggagaccattagctggaagccagtgggaagtcgggctgactaatagggacaggtgtccaggaggctgcagtgtgaggctttcatttgttcaagcaacacacattcactgcactcttaccgtgtgccagggacagccataggccctgagactacagcagtgatggagacagacgctgctcccatcaaggtcatgttttgatggggaaagcagcaataagccaaatacatatgggtctggggtgccaggctagacgattctagtgcaatggacatgaaagaggagagaggtgaaggcacagtcttcaatcggttgttcaagaaaggcctcactgaagtggtgacatttgggcagagacgtcagggagggatgagggagccacccaagtgtctgggagaacagcactggggcagatggaacagccagtgcaaaggccctgaggctccagtgaccagtgtggctgctgcagaaggacggggaggggaggaggggaaaaccgtgtagagtggcagtgggaggacagattaaggctgcaggtggaattaaagttgctctttcagctgactttaaagtagggagacgattccagattatctgggtggccttaatgtcatcacgaggatccttaaaagtggaagagggaggcaggagagtcaggattaggatgaagtggagatatgtgagaatatgaggaagattcccctggctgtgctggctctgaagacagaggaagggcccacgaaccaagttacgtgaatacggacagactctagaagctaaaaaaggcaaggaaatggattctagagcctccagcaaggaaggcagccctatgcatgccttgactttaggacactgagatccatttcggacttctgacccacaaaaccaaaatctagtaagtgtgtgctatttgaagctgctaaatttgtagtaatttgttacagcagccaccagaaattaatatggggaggaaatagggatttcatctgtccatagtaaagacatgccgggggtgataagaatctgagcccatctcacctagatgagaacgagagagtaatgaccacagaatagtggtgatggccatcctcacatctggctccttagccacccatgccagtatggactgactgccttctacgtcttgtccatggccattctctagggaaattcccttgcatctcctgctacctttacagactacatattttgttggattactttctcattttcatgaagcatatcttctagtaacttctgataaaagatgcataggagataaatattttaggacttccacagtaccagaatgatggatgaactgggtatagaattccagattggagatgatttttttgttcagaattttagagaatattgccccattgtcttcttgctaccaggcagctattgagaagtctaggaagattctgtttcctcggactttgtgtgcagtgtgatttttcctttttggaattttatagaatcttctttgtcccaagtggtcccatattccacaatgatgtgccctagaatgtgtctgtttttatccactgtgagttctttccaactgagaacttgtgtccattagctctgggaaattttcttgaaatactttcttagtgatttctactctctgttttgtttcttcttcatttttgaaacttgatatttatatgagctttcttctgcacatataatctgtgtgtccaccaaatggctttgctctgtttgtttcaatctgtctttcctgaggcatctgctgattcttggctttctgcccatgatgaggagctgactggaagttctgacagtaagagaggaggggttcattgcccttgagacccatgaatgggagtgatccttgatccttggatgtcagtatctttaggaactgacctgattcccagagaagttacccagggagcaagggagggtctggctgccagtcttcttggagtcaacttggagttgaaggcaggggtctttgcagtcagctgcctgaattctgggaaataaacctctggacttttgctggtgtgggggaggggtggtcgctcagggaggataaggaggggataggaatccccctttactaagccatcctgatcgtagccgctcttgcaccccaagtcctagaggtaccctttttttttgacggagtttcactcttattgcccaggctggagtgcaatggtgcgatcttgactcactgcagcctctgcctcctgggttcaaaaattcttctgcctcagcctctagagtagatgcgattacgggtgcccaccaccaggcctggctaattttttttgtatttttagtagagacagggtttcaccatgttggtcaggctggtcttgaactcctgacctcaggtgatccgcccaccttggcctcccaaaatgctgggattataggcgtgagccaccacgcctggcccctagaggtaatcttatactcagtcttgagtgttaggattccccttggttataaatctggtaaaatctcaccttcctgctctctattcaggattttctcttgtctctgatccaattgccacaggtccatcagcaattcagctttcagaagggaggcccacccttatgggtagatgccttttgaaatctctttattgtggttgaagtggggcttacagaggggacgctattgaatgggtgtgtgtttagtttgccatcttaacccgaggcttttgtggctattttagaaagactgtgtccattcttaggtctaggcccgataccacacacagtgtccacacacaggggctctgaccccacagggttctttgggtcctgatcaatgatctttcaagagcctcccccttgacctgcttctggccacagaaacagctgataaatgaaatttgttagtttcctacaatggagtgttgcatcagcagtgaacatagtgacaagagtgcatgcttatcaccacgctgacatgtccctgagacatgggggcgacctttaagaatgtcagctgaaatattaacagcggttttccctgggtgattagatctgataatattaaaacttttttctctgttatgtttctctgcatttaatttttctccactgactgtatattagtggtggaagtgttacaatgtttaaaaataagaacatcaaaaaattagcccagggtggtggtggcatgttcctgtggtcccagctactcaggaggctgaggcaggaggatctcctgagcgcaggaggtagaggttgcagtgagccaagatctcaccactgcaccccagcctgggtgacagagtgagatcctgtctcaaaaaataaaaataaaaatgagaagaaaatcctatctgtccttcaataaccagctcagccactgctacctcccgggagtctcccgtattcccactgttgggaatgcttcctgcaccacattaaataaactgca

SEQ ID NO: 3226 - DNA, 301 bp, Homo sapiens
agaaattctaaagttggaaaaagttgagagagaagggaggagtgacaactgcaggctgctggagaaacagcaaggttctcagaatttttcttctaccttgatcaaatgtcacagaaggtacttcctggtatacacacaggagttgcctgcagaaaacgtcctgcagaatgttccaggaatttgatctccatgtactgttctgagaggctagcctgcggagaatgaaagtaaggagcaagcaagtgatcattactcaccacctcaatccacccaagggctttcacctggaacccaaagtgcg

SEQ ID NO: 3227 - DNA, 7063 bp, Homo sapiens
aaaaaagtttttaaggaaaaaaaaacccttccctatttcctggctctgagaggatcagcgtgtacagccctcccgtggtagaatggcggctgcacagctcccagcaggcacggtgcagtgcacagctcccagcagtgcttagtcagatgcactcactcatctttcaaggagggtactgtctgtctggggagatgagccctaagaaaatgaaaaagataatgagctgtatgttttctaatagctggttagaaataggccttgtgggaacaggactagctttttaccaagatgttcctgcagctcagcacccagggcagtggggacaggagagagaagctgacacagcgtaggtcattggaatttcatttccattccgtctacattcgctgcctgcccgcctctgtgggcaccagtgttaactgggcaggcctcgcttcctgctcccattcctcctctcttagccaggaccacttgatacctatttcaggcttgtacccaccccgggttctgtaacaatcctagctcaagagaggaaatgtttaagaagcactaaagcaacattctgaaagtcactgacaagttcactgtaccagtgggcctgctgtgacccactgccgctgctttaaccaccagcactgacctcattcccaaaaccaagtgctcctctagggggaactgcaggcatagccatgggatctgggtccctggtttatgggaggggctcaggtcctcatcttgacgtctgcccagaatccagtggttctcagctgggggctgagcccagaatcacagggaaggctgaaggcagagccagctaggagaggtacagttcctacttcacttgttacaagtctgtgttttgaatttttacaaccaccatacattatttgttatcattttaaagtaccaatagaatgaactacttattactttttattttttttaagagagagagagagagagagagacagggtctagctctgtcccaggctggagtgcagtggtgcaatcatagttcaattctccctcgttggcctaccaaagcactagaattacaggcgtgagccaccatgcccagccagaactacttattgttaatcaaacttatgaaataaagatttaatgcctatgtcctacaacagacctgccatatcagggtctccaggagcaagaaccccaccaggcccctgtcccaaggtggagacagacacctatatcaaagcataaaatagatctcattgtgctaagtgttaataaaggtctgaataataaagtgctgtggcatgcctgaggaggaagtggttaagggttaagtccaagcctgtttctgaatcctggccctggggctgaagcctgccaccacctgtcctgcagcccaactctctgaatattgccacgtctgtctgcctgtcagcacagcgttggagccccttggtagacttacttgatgccaagtacccccctggtgtctgtggtcattgtgcatagatcttggtctaaaaggctgcctgaacttcctccatacgtgtcaccactgccaccctccctcaccccaccccaaacacacacacaggccttatctctaaactaaaagcctgtctagttccacctttcccactgcagtcaaccctcccataattataataattgtggccatcactgaatggccacctctgtgtaccaggccctgggtcagagcatgtcataagcgttatgtcttggaaggggctcttcatttctccttttttttttttttttttttgagacagagtttcgctcttgtaccccaggctggagtgcaaggcacgatcttggctcactgcaacctccacctcccaggttcaagcgattctcctgcctcagcctcccaagtaactgggattaggtgcccaccaccacacccgactaatttttttttttttttgtatttttagtagagacagggttttgccatgctagccaggcttgtcctgaactcctgacttcaggcccacctcggcctcccaaagtgctgggattacaggcatgagccaccatgcctggcacatttctccatttttattgaaaaggatactgaagtcagaaagaagaagtcacttacttaccccagagcacacagctagtaagtggcagaggcaggacttggaccccagctggctgactccagagaccatgttcccacagctggtggggatagcaggtccagccacaaagctggtagcactcggcccctcccgtggagaagctcccagtctggcagagcagacacggtgcagcacaaagcctctagctgagatagtgaagtaaaactaacatgtacagggacatctgaggaggaagggattttaagtcaaagtggtggggccaggaaggctcctttctggggtcagaggagactccaggaccatccttcatgtaatatacccattggtgctggttccttatctaaataaaggtatcagccaacattgagcatttaccgagctccaggccctgtgctaggtgcttagataagttacctcctggagtcctcaagccagtaggcctagatactcttattttctaccatcttacaaacgaagaaactgaaggtccgagaggggaaacaactggcgtgagtgcgcatgcctctgaagtgatggagctgggatttcatttactcacttgcccatccgatgagtttattctatccctgccacccgccaggccctgatctggatgatgaggggccagcagtgagcagcacagacaggcctttgcgtcatgagccttagatctcatggggaggggagccacagggaacaaacagacaagagagcaccagagggtgagggacactctgcagagagcctaaaacacagggcatgataggagccatggggattattttggatttgacaacccccgggtctgtccaatgccagtgctggagctcttggccactggtcctcactgtcactccctgctgagctcctgcaacttttggttgaggcatttgccccattataccttgttttatgtacttatgtgcttttctggttttttttcttaaggggtcaacctcaccttattcttttctgtatcctagtggcactgaatacagtgctagataatgacagatgggagagagctggggattccattggaaggggcacccaagcccaggcagtggcactggctgaggatggccagttggggccttggcaccataatgagaccttttagaggtgaaggctgtgttctggtgacaccagtgaagagaagggtcagccagtgcagggccagtgggaggagcacagtgtggacggaagggctgggacagaggagccagcaggagcccacaacatggtgctcctgtgaggaggtcagggcttagcctagaacagcagcaggggcacaaaaaaacacctgagaaactgtatgaagaggctgctgctggacttgggttggaggtggccctgagactttgagaatagttatgctaacaaaaaggaggagttttagaaggaaagctggttgtgtgggagataaaaagccaatagccttcactgagtgctcatcatgcatgaggccctgtgctaaaatctctgccttgtctcactgaattcccattacaatccagcagggtcagtgttctcatgatgcctgctttacagacgaagacctaaggccagaggctaagccatttgccacacaccacagaggcagtaagtggcctagacagggcttgatctcccatctgtctgcccagtctgtgcccctccaaccaccccacccccaatccactacctcctgcttttaatgacttggatgtggaatcagttacatctgagaacaaacgacatagtctaggggctgcagccctggggagaatgtgtgcctgagcccgtgaatttagggttttgggcacaaagcaaaatttggagctatagaagtggggttttactaaggagagaagagccaagaaattgaagaataatctgaggtgggagagagggcaggaggcagaagatgtcacccatcagaggctgcagagggcaggatggatagatgagcagaggccaaggccttcggttggggagaaggagatcttggctgagctcaaagggtggttttcctggaagcacaggaggccaggctctaagggttgagaatacaagtgaggaagtgaaaggagcaggaggctcttagagggctggagttttgaaaatcaagaaggaccaaggacaccatcaggttgagtgccctcctctcaaatgcagaaactgaggcccagagagaggagtttgccccagaccacggaactaggtgttctgacacccttttcattgcaccatgctgcctctcttgacatgaagaacagagaaagaataaagtgtgaagacatgccgtggcgattttaaggtgcacagactttatctgttggaggcagaaggatgcctcgctggaggtacgagagcggtaaggttgaaagagaaccagaacattagttcagatgttggctgtggcgtgtaccagtcaagggacttaagtgacttcaccctgagcctcactttcatcttctgtaaaatgataattataccataatgtcaataatattaggttgatgcaaaagtaattgcagtttttgccattggaaataatggcatataaacctgaggcatttcaatagagagaggagacataccaaacacagagcttctcaacggctatgaaaagatgatgagaaagtcccagagaagaaagaatggagagacttttctttcttttttttcttttcttttctttctcacttccattgtattataatcccagcccccaatgtgcattgtgggtgctggtggggcagacatgaccctatggcacctgcatgacagagggcctcggcctccacaaatgctcacaacttgtaaaagtcttttcacagggtcagcatccagcctgcccactaccgttgcccgttatcattgcaggttaattttgttgcagctattgatgtgtacgaagatggagaagctggtttgctgttgtgttacaactgaaggaactgaaaaataccttcctccctgagtctcccgctgcgcaccaggcctcttggtgacacagtgcaagaactggcacttgtgatgctatctccaggatgcgccagtgatgacaatggcttccagttaggaggcccttactgtgtgccaggtgccgtgctcggtatgctgtggtcattgtctcacttgattctcacaatgaatgcccgcagcaggctcggttattatccccagtttagagatgaggcaactgaggcctagagaggtgaactcgtcaaggtcttgtggctactaagcagcagggccagggtttgcatcgggtgctctcttgactccagcacccacaattttaaccactgtcgctattctacattttgctgtttctcaggtattaatgaaatcagcctcaacccagggtatccagcctcagttggcctagtttggattaggtggcagggtaggtgttgggcagaccaaaggtatcaaatgggatctttaaggattttcagcatttcaaaagctaatattataatacattttcataaaaatgatgttttaagggtaaaagaaaagaagtaagctattttcctagataaagctgcccagtctaacaagacataaaacatgtttttcggcctaggattttatcaatttagagtggtaatgctgggtcagatgttttgattaattaatctttgattaataagtataagaaagctaattattagaagagaaggttgttttataaacatcatctttcaaaattcgagatttatggggaataaattaggagaaggtggttaaacctcttcaacaataaattgctctttggggacattttatgcacagaactgtgcaccctcctcagaacagcaggtctttaatggcccatgtgatgagaagggccccatcaaggcagcaggaatgggccactctcccacaccccatgggccaggccactgccactcctgctgccctgcatccccaggtttatggctgcatggtagaagtcacttctgtaagaaattcacctttctaaaataaagtatgctcttttttctgagacatctatagaataacttgtggcagagtgttttaaaaactgatttggattttttttatcctttaaccgtgtgaaaggatggaagggattttaggtggaagagaagttaagaacagaaagatagagcaggtttttagagtgggagaattaatcccaaagaaaaagagggcatggaaacaaatgtggatgccatgggctctgtgccagacttgccagtgctgactggaacaggccgggctcctcactcagcggctcctgcctcagctgtggttcccgcagcctctgggtctcacggaacccttccttgggagttccatttctcatggctttgctcatcttccggcttcaggctctgacttcatctcaggatgggatcggtgtgtgtctgttttcatagatccactacatcagaagtatctttacatctctgtatctttacatcccaaggtcaaggccctggcaacctcagaggttcccatagcttcagtcttccccaaaccatgccacttcctcccatttctttgggtcaggaatctggcttttgttttccatatttctttttcccaagacattgggaggcatctggtgaacaacaccaataaaacagttctctccccacggtcatccaggtcacttctctaactcattcctgcacacacagcacacgtggaatttgcctgtttagtctatgttcttgacttgatcacagacgcctgtacaataaagccccttttcaacaaggtgctgcagaatgataatgctttccccaaaatctgaaactgatttgtatcattgaagtttttttctgtattaaaaataaagcaaaattaaaaataaactttatgtggaggaatttttatctcagatatgttagagttgaaaatattttataatggagattgcaactttcagttatgtgttatttgaaaaaaatatatattcacttggtaacctttag

SEQ ID NO: 3228 - DNA, 5456 bp, Homo sapiens
ttttaaaatacatatgtttgtaaattatgtacatatgactacataatatatatgtggcatatgcattatgtgtatgtggtacatagacattacccataacaattagaaagtacctctgtctccgttttacagatgaggaagctgaggcacagagagattagtgacttgttcaagatgagacacacgctggtaaatggtggggctaggggttatgtatttaatcaccaggtgatactactatacctccacgactggatgtttcctgggtgtctcaggaggcacttcgatttttgcagtaactcaagaactcaccagtaagaaccttagttaggagttcgagttggtaggaaaacaacggaccaagactcataacctttcttctacaatttacgagttgtatatacttgggcacatctcttaacggaatctcactatcctcatctgtaaaatggagattataacatctatccacatacttcatagaggtgtcataaaggcacgtaacataatgaatctaaagacccctgaaaacccttgaagtgctacataaatattcagaaatggtttcttacatggtcatggttaggtctggaatgctgtgctaaggctttatcactctgagcccagtgccccctttcactcatctgtgctatatcaatgtgtctttcaagcaaattcacatgctaatctgtgttagttcctattctgcagaaatgagaagtgttaaactcattctttaaatataatcccctcactgctatgatagagaatgtgttacaccattaaagaacccacctctctttttttttttcaaatttaagaagcattactttccttttctccttctttcctaagagactagaatcctgtattgcaaatggaagttccctcaataaattttaactgagtagaatctgggatgctcagaatggaagaggtctcttgtaagctggaccaagactttacagataggaaagctgagggtcttatctgacatcacccagcctattagggccaacgtgggccaagagcccacgtgtcctgacttccagcccagagccagttctgcttcatgaccctgccccttgcactcagaagctgagggtatttgtggtttgtttgttttagtgctttcttttattactgatagctcttctgcaaggaatgcctcccctctctaagcatttattctttgttacttacagaagaagactgcataaactgggcgtgtcaaaggtcacccaagtggatttcctgccaagggaagtagtgtcctactcaaaggagacccagactcctcttgccacgcatcagtctgaagagctcttcatgggatacaaacataatgacactgaaagccaaagcctcttctgagtttgaaagctatggagagggaactcggtgatactcttccaagtgacctggcaactttaaattagataaactaaagaggtttatctcactacatcgaaatcatgtgaggagaacaaaaatcatcaaagaacaatgtaatagaaacagtgctgaattttatcaataagaatacattaagcatacattaagaatcttaagcatacattaagattcatcatttacatggcttagcaaactatagcccacccacctgttcctagaaataaggtgttgttggaatacagctatatccaaccattgacttctgtggttactttcttgctgcagtggcagggttgagtagttgtgaaagagaccttatggctcacaaagcctaaaatctttattataacctggccctttacagaaaacctttgctgaccactgatttggtttgccaattgaggtaacaacacacgagagtttctgaccacaatttaaaagtattttcccatgcaaactccacataggtgaatggaaattgaactccataccttctttgtgtatgccagaaaaatatcaagtgaaaaagtcacatacgggtatcagagaatcataaaaatacactcatgagagaagtcgaagttgataaatacttcctagaattcaaaactttatcaaagcaagattatgcaaaagcagaagagggagatgtattttgaaaatagggtaagtgaaagtttcattgttagaggctaacgttgttatagcaaagcaaatactctttttactttatgttattttattcttcggtgggtgaagaggatgttggaattctgggttccttgttgctatgtagtaagtatggacaaaagccatgaaatgcaaaaatgattagcatttcccccttagtgatttaccggaaatataaaaatcagtgcatttttgtttatgcaagctacaggttttcagttttggttctaaataaataacgccaaaagcaaagtgaatcagattccttgaagtccggggtgccgttaggcattctgaaaatcttgcctatacaagctgttgtggggacagttcttcagtagcagggcctccatttctcaagccccagtgaaatgaattttagaagcaaacaagtagcaccctctgctggtgagcttttaaaccaaccaacccaacaaatgagacctgtatattaacgtggctgaaaatacagttagcgagggggaaagaaagaaaagaaaaagaaaatacaaaattagaaaagcctgtgagagttcacctagtctatccttgggcctccagacaagaacaggaagatcgttaaaaaacatcctcaccacccaaccaaaacatttgtttgacttaatttgctgccagaggtatttgcagagctgtagctggaggcatgtttatttagcccaaaacttgacccatagcataaagttatacaactgaaataggagaaggagtgaattattttttaaaatgtgtacttaagatattggaagtggtaaagaaatatttacaagggaagataaattaaggatgaaaaggcatcagctctaaagttttaaactggagcacatcaaaaggaaaaggctgtacattccattttattactgcaaggagagcttgggagccctcattatgctgtggtccaagcagcaggaaagggggaatttatttctcagctattggcagaagttctttctgttttgttcacaagatccatcaagcttttttgtggtgaagggcatttacatggttcagattacaatacagaacccaaagctagctaccatagttcttgacatttaagcaatcctggatggatttggacagaaaaacctttcaatttgggttcagcaaactgcccctcaccacaggcgatgatgccttgacccttggctgccggcagtcacccggctgcccggccatagagggtgctggtgctcactttcacctgctgtggggaggtggttggcaggagagctgcgtggagcagtggacagttggcactgaggttctaccatgcggcagatgtgggttggctccactgtggggtttgagccatggcaatgttttcatgaaaactgcgcctttcagcggcaggaaacaactacggaattttatgacacaatgaggctcttgggtggctaacatttgaagctctggcatatataacatccactttggcttgctgttgcccacaatgtaagaaggcatgctgattattttttgtcattgtttgactgtggacagtttaatgataatcaaactaatgatctcagagcattgatttgttctgcctctaatggattctagtgcattcaagttcttacacattcccattttacttttgaaaatgaaggggaaggcactttggatttgcccaagcttaagcatcctttctgtactgtgcaccgtaatgaacattctcatcatagtaagtattaatttttgatcataatgatctgttatgagaaacactccagacagtgatataaataagcaagatttaagtataaattctccatgaatactgttctttcaacaaggttagaccttccttctctgcagggaaagaaggccaagaatggccaacactgacttggagaaggatacctttgccccaatatatttgaaacacataattttattcccaagtagcaagaaaggaaaacgaaattatggtcccctccaaggctgcctctctgttgcctattatgaacccatttctgtaccaaccatgaggtcctgggcttagggagccagtcttttgcatctttattatagtgagtgagtgcatggcttatcctgagtacccaagaaatgctgttgaacgacaaagataatgccagacatctctagaaacaccaagttcactatgttccccctgggggaatgagaatttcttaatctgctggaaagatgcaagccacactggaggaaggaggaggaaatttctacaacctggtacataatcatagtttgttttgatagtcacctggtatcttgtggtcaaggtttaatctctactcaggcccagtagcaaaccaagacatctctctcaaagggagagtaatgcaataaagaggccacattattattctaaaatctaagcacttcttctgagactcacctcttagggacatttgtttgatttgccatagacacttggggcaccattgggtcagctggaccataatttccaagtagtatagccatttgaaagaaaaactttcaaaccactgggtaaatggattgaataaataggtgcaaatgttgaacatgttgcctgcaaaacccagaatgacccactaagcatttcgactcttaatattagagaattaaggtattcacatatactttggagtttaccagatgactagaccaatagagactttcttaaggtagcgagtacttatgttttcaaagatttttcctccatcctctggcctacataatgtcttaactaggtcttaaagataccagctacagcttcctctccaggtcctgctgacatgatgctccatgttgaaggtgagattgacaagggctacagatagagaactggctcagccctgaggtaggatgatgaagatgcaaagagaaaggctgcaggtctttggctgtcaagcaaggcttagtgtagaacatggtttggaggtactcccaggcctccgtattcttacctacattcaatttcccattatttcctgatcattgctgtcactttcacataagtcacctggtgacactagcaattccacagaccttattcagaaacccacagaatttaaactttgcatttgactttgacatttttgtagatacttatcacaagcagagaaagtccatgggtctatgcctagatctaaaatatagagacttcaacctgtcatctatttcttacagctgtccagtcccattagaagtatccacctcatcctagtgtctttaaattcttcatgccactcacactattcaatagcagtgaaaatttgatcccctaaatccttcttttcaacggacacttcattaaagatcaccatagaagaaaaattatgtagctatttgttacagctgac

SEQ ID NO: 3229 - DNA, 1668 bp, Homo sapiens
cttttcgattcagaaaatgtatactcaaatcgtgcccttctctctgcagctcttcccctgcttctctcagcagactccctcttcctcaatgctcccagggacgtgctctgctcctctattataacgtttgacacccgcttacattaattcatttttaccatgtttgattttctcattctcatttatattatgatttttttcaagcttgggatacgaagctgtattagggagaaaggttgcacagtttaaaaaacacgttgatattatcatcacattgactggatgttgggcattgtatttcttttattttggaattccagataccatgaaaggatttgagcgtttttttatgtgaatccaaagatgacatttacaaaaggtggagaagcagttccctactgagggacgtggatacaaaaagcagatgacacaacacatcccatagagttcccagggaagaatgaacccagattcttgacctgcagaggtggcgtactggctggagaaatctctggctggcgaccgtgctattctgtctgtccacctaactgtgggctcccagatcaccactgccatgggcagggggccgtggggtgggcctgcttggggtgacaggctagctgtgctcccatagcagaggtgggagaagggaatcacatctggtgagcagctatgtcgtgccaggcactgtgctgtgtattgcacacatctcaaaccttgtgacaaatgtgtaagatattttttatgtattacaaatgaaggaactgggctcagaaaagctccattatttgcccaaattgcagcagtaatgcaggaatttgaatccacattaatctgactccacaacccatgttctttcactgaattcccatatccttgttccccctactgtcctcactggtcaaggtgagcttggtcttccacaaacaggctagaaaagtatgcttacttatctttagctttatgcttttaaactaattcttaaaaatcttctctggataagtcaaagacaatgggaatgtgtatttctaatacattaattataatacattaccggtttacacaatgccatcaccttgtcattttctttgacacaacgtccccctcccctctagtttataaatgaggacattgaggcacaaagtgggtaagtgacttgcccaagggggagatttgtccaatcataaagatgggcctgaactttttctactttgcattcttacttgaaaggcaggaaacatatgctcaagagggagatctcacgaaatttcatgtcatatagtgctctcgctaatttaatcctgtcattcctggttatatccctttggaaaaaccaccaccagtgccttctcttttgatatatttacagtaaaaatattccctgtacaaaccatctcactctttcacagggaactggcttggccctctcccctgaagtgggttgcacatccacccagcccacccccagctcactctagctcccttcctgttagaatttattcagaacctccatttctaggaggaagcaaggagggggcagttatcttcgtggacttgggtcctcctggaccctttgtcctcatggttatgtttcaaacagagttgagggctccctaaaggggaaagattatttaagttttgtaaatgctgccctccaaaaaccactcc

SEQ ID NO: 3230 - DNA, 13604 bp, Homo sapiens
gatctgatgaatccaaggagtggagcaagaggcagattttggacacggttatgagaatgacagaaactgcctaaagcatttatgctctggcattcgtccctgtttctggaggtccagtaagcgcttcccaacagaggaccatctgatgattcataggcacaaacatgaaatgactttgaagtttccttcaataaaaacagacaatatgttatcagatcaaactccgaccccaacgagattcctgaagaactgcgaggaggtgggcctcttcagcgagctggactgctccctggagcacgagttcaggaaggctcaggaagaggagagcagcaagcggaatatctcgatgcataatgcagttggtggggccatgacggggcccggaactcaccagcttagcagcgctcggctgcccaaccatgacaccaacgttgtgattcagcaagccatgccgtcgcctcagtccagctctgtcatcactcaggcaccttccaccaaccgccagatcgggtaaggagccctccttggctgcccctgggtcctggctggaactcaggaaatgtcctggacttcctcctggtttctggtgctcagattggttggtttttctggctgtcatgatattgcctagagctcagagtgatgcttttgatgggagaagggaggagtctctgcttggtagaagctgttttgatcttggactttgggtggtaggggtagggtggggagcaagtcattctgtgtcatcatttcttcagacaagatttatgaactttaagatgactgtgggaaaacccatggttgttatggagaccagagtatagtgcgcagaacaaacatggtggagggaagttctaccagctcagccttgtctccaacagagtgtgcccttcccttcctgggagctgccacactcatcacctcatcttctgtgtacagcaatccctccctgtccgtgagagataaattccaagctgcccaatggatacctgaaagtgcagatagtaccaaaccctgtgtgtgatatgtgttttccatctgataactgagatagctattaagtgactactgggtggggcgtgtccacaatgtggacacggtggacaggagggatgattcacatcctggggggcatagcttgggacagcatgaagtttcatcatgctactcagaatggtgagcagtttaaaacttgtgaattgtttatttctggaattttccttttaatatttttggaccacgattaactgaaactgtagaaagcaaaaccacggataagggggaccaccatatttccacagtcgtcccgccctctgcttattcttccctgcttctccttcttgtaactgcctccttactagccctctccttcctgttactgcctccttattagccctctccttcctctacattggtccatgctgatttctggagtagacaaagcaaagaaagcaggcccctctctctcatttatgcaaatggtcaatactgaggcattgaggaaaaattggtagaaagatcctgtcattgaacaccagatactccatgtcatgtgatggaaagagctttcccttctgggtatcctgtgttagctctagcccctcgcaatgtgccaagtgtggtctgaggatccgcagcgtgggcatttccagggagcttctcagaaacgcagaatctctggcccagcttccttatccccagaatgaggatggtgtctgctctttccagcctcatgagagtaaagatgaaataaaagatttaagagcacatgggttcttaggaagaaaaggtaataactttaagccaaagagctgtgatacagttctgttgctggtcgctgagaactggctgctctatgcttccagaattctgtttaaaatgagaaggggcgcttgctgtgtttggtatgtgcatcaacattctgtttgaattttcagtcaaatattggaagtgataattaaaaacttagaaactgctccacaatttgtcagtaggtcttttccctcttgtttttcggtgttataagaattccagacctgcagggaacactggcttattcctccctaggatattccagaaggggcaccttgtctcacattttcaacttaccaggaatggctgtgatacgttaagacccaccttaagaaatgagagtaatgggtaatgggtaatgaccattttgtgagtttgctgtgggtgcgtttggttttctattcaagaaacagaacattaacctggcccttcgaatgctcggctttgttgaaaggagtcaatgctaggttggtaagtgtctctgctaaagatttcttttcttctcaaatgaccatgagagcaaatgttgctgctatctaaatcaagaacccatagagtgctaagagggtggagtagattcattaaagacagcatctaaatctccagggacttctctcaagtggcttggctttcagcagacaattcacagttatgccagctaattataattattttatttttctttcaaggggaaaaaacataaaatgtgctagagtttactagcagttttacagcattccttcccccctggagttctcctgcctccctctccctgccaccccccaccaactacccttttggaggcccttagtattcagccattgttagcacaaagctggtctttatgaaacagtcttttgagggctagcaataaagtttaagatgagtgctgactctgttgataatttacccagctggcccaggactgtacatttgggtgacatttgtaggctgtgtcaccatgcctggatggaggcgggtgtttctgtggtatggacgccttttggacacactccatcttcccatttattctccagcctggggtgttgtgtgtcgctcctggtgtgttctaggagataattgtcacttttaggactctgtctcattgccaagcccgagggaggctatttcttttattcagattcctccctggtgtgtttgccatgttgattcaaacccacacatcttgtcgtttccatttttctccatccaaaaccttgcccggatgatcctggagactcagcaagaaataacccaacccatctcaccagtggattcagtatgaaactctaggtggtaacatttggggacggttgactcttttatttctctcaggaaagaggaaatgagtacttatttgaaaacacgagttccctctggagactgtgtctttaaatgagcatttgaaattgcagatagctttttttttactttattttttttgaggctgcacagaaccatattgtagtaatattctgatttttatcacaacctcaaatatttaagtgtcaaaatctggccaagccacctgcaaatgtttgccatggctactggccaagaaaaacagcaaacagcaatgaaagtcttcattcaggctcagtgcttaagctgcatccagccagaaaggctgggacccacctgtgcccacgcatagtgctcttgtgctgcggccagcgggtgtgttcatggctgagactttgtgggagaaggggccacctggctcctgctcccccctcttcccttcccttctatcagtgcttggctgctgcaggcaaccccaagttttcgctcttctctgtctccctcttttcacagtacaaaatttaagcttggaggcttgaatgtattgagagagctatcaacataaaggacttgaaaatgggagtagtgccagttatcagggaggactttggggacaaagggtaggcatcctcataagcatttgattttcatgctttttgaacaggcactgagccaaaccagaccaaaatgagtgcaaatgcaaaaatccaaagaagtaatgttaaaaggaagtagacaaacaacacgtgcaacttccattccataccacagcaatccataccatgccctgcgctcaattctgtgaaagtagtgccattacctcaatagaaaccagaggtaaatataaatatctcaaattgctcttgtgtggttgggcagactagaaaaacacacagctatggagagtgtgggaggcatccccaaactagtgactacttgtgcttagtcaaactggcagacgctctgccgggaagagtgtctttggctgattgatggtagcgttttcagagataagtttcccagatggaaaaaaagagtgagccatgggctgtggggaagacaagtgagacagaaaacaagcatgtattaaatagagataaaatcgatccagccttgaaccaaatatgtggcagaatccaaacagtatctctcctccagtcatttttattagctatcatgtaacaggctcattaattcaggatcaagtcagcaaagcctgggaaaatggcagaagggtaggtagcactactggaagttaacacactctctctgtctctttgtttcttatcatctaagacatttttgtaggagtcaataatccgttgagtagatggctataatcttaatagatcccagctttcttaactaagttgattcttctttatggataagtgatagtatataatttacactcagtaattcttcaggagagcaatgaagataatatggaatttggagttctacaagaatggatatcagtacagagctctgacgggttatgggagacgcttccaaaatattctacatatttttttcttaccttttacttctttgtagggcactggccaaatatatctaacattagaatatacaaatgtggagtattctggttaagagaatgaattggccagctgcatcaggaaactcagaaatatgttcaacagaatgcatatatgaagacatttacgtaaaaaaaccctccctgattttacaccaattttaatcctggaacatatatttccacatgatgcgtaacttaggcatttggttataaaccctatttgcatggggctgtagctagacaacagagacataaaacttagccagaaatttatataaaatatcatagaagaaaatcttgttttatgtaaagatgaaaaggtgccaagacttataaattgtacctcctcttaccttttctgtgcctctttatcccttttctctttgcaatcccagatgctatgtgtcatgcagaatattagatgtagttcaatggacatggctgaggaaaacaaacaagcaaacaaagaaaaataataataaaaagaaaagctgattacatctcaaaatttgttggtggcagaagcaatgctacgagtcatgtggctttgctgtgtgagttcacgttcctgcccagtgttccctcaagatgggaatgttaatacatttgagggttttgtgtcattgttgctgggggtggggaaagaacagtagagaagtgggtaaatgatgccatcactgaaggtcatggcttaaagaagacctaaatgacaaagcagcttacaggttaagaatgtgtttgccctgtcaatgcatatgcgtatgaatctatttttaagagcttcctaaagctcctcaaaccaaagtgagcatgagtaagactgtcgctatctaccacaggctaatgctggggatattcaggccagcctccttcctgctggagacagcggggcagcaggtcccggcttgtcactggtcctcagcccttagccaggacaacttgaagcccctttgagtaatgcagaccagaagtcattatttcctgctttgtgttttgctgaatatcacggctatgaacatagctttattgttggaaagttgctgtatctttcacagccccgagaacatttacgagggcccttctgggggatgctttctgggagggttgacagacttaaccatatggctcccgttaaatcccatgcagagccttgagaaattacctctgacaagggggccggcagccttccactcacggggttttatgtgtggaacgaaacataaagtactgatacttgaggaaatataatgtttcttaacattcaaaagttgtaacaccacatggtattgtggtcagatgaagggggtagagccagaacatgggagcaaatggctgggtattctgagaggcagaaaaataccccagctctcgtcttcgaatctggtccttgcctctgattcttcaggcaagcattgtgtcttagtgtcatctcagcttcccacctggaacacagcaagcctgctctactcgggagagaaaatcagaggtaactccccaatggctcaagcccttcgttagaaagggccttgatactgacactgaagaagagaaaggaagctaatatttattcaggatctactacgtgtcaggcattgagctagctttgcatgttatttcctgtaattcttcaatagctcagagaggtagctgttatttaccccaatattattgctccaagaagaaaagtaacttgtccaaagtcacccagccagggagataaacagagttttgaatatgggtctattggactcaaaagcacatgtttccccatgctcctgaccgtggcaataccagtgccgtggaagacccatgactgtgcctgagactggcagaatcatctacaggagttagctaatgctcagtctatctgtttacagtgtcaaacacttcatcccctcatgtgtaagaaaactatagcatcacagagaagtgatggccctgtctccaacatttggttgctctatatttggcttcttagcttgcaggaagaccactattccctgcccaaatgcaattcaacttccagatttgttccatttcctgaggggacagttggctttgcctgtgagcttttcttggaggaagacttcatttctggaacttctacacagaacctggccctcagagttcctgaagcttccatgtaagtgtctcagtgtgcatttcctccctcctatttttggaaaagataggcacaaatgagggactacttctacagcaaccagcctggaatcattctttctgtgcttacagtaaatctagacatttgttcttttgtgcagcatattgaaaagatatgcctggaatacaagagcttgcttggagcaaaaccatggcaagtcagaggggagtcaaggaaaagcattgtcatgggttcagagttcatggattttagacattcaggctctgccatttaaaacatttgccaccttggctaagcgctcagcttccccaggcctggtttcctttacctacatataaaggggttagccaattaattgagtcagtctcagctccagaattctcattcactgcctcttttctgtctcaaatttattctctcttttggttgttttcttccaggagccaagtttggcagaagctctagattatctgacctcctagatatgttcacatagcccagagagtgagaacagaatagggtttgggaagagaagcccacggcagtaaaagggaggggtcctaacatatgaagtcagagacacttgacttctaggctcaactcctaggtgaataacagcaacctcttctctttgtcaggtgctgtttacaaggcacatctctactagtttggcatgcatgattctgttacccaggaattaatacacccattttgcagttgagtaaagtaaggttcagagattaagtgacttgccccaggtcatagtgataatggccagagccagaactcgaatccagaccacctactccatgcactatcccacagttcccaagaaacttaactttcccaggtttaagttttttcacctttaaaattggggggtggggtaccactagaaaattcttgaagttcttttcagcactaaaatgttaattattttcataatgaatttaattttgtaaactacttggtaaggtaacttctctggggactcagtgctgcgtgtgtgactaggtatagcttcctctcttgaagtaatcttatcaggaaattgttcttttattctcactctgctaacagtggcttattttcggagctttaactagaaaaacaactaaaatagtaaacatgtaaaacaagtccaacgcaagagatctggatgatggttttgccagagacagttctatgggaaaatgcagtccactgtcttgtattctagaattattattatttggggaattattttgtggaagatctgaaacacagctttagctcatatcactggttagtgtcttcctctgtgtaagccttggataaggtgccatgtgagtgaatatttgggaatgagagtatgtagtctcccataacgcaaactgaaaaaattagctgttcttttctgtacttgtcatagttcctacatcaagattggctcagtatttcctgtttacaaatccagaagcaagaatgaaaacctagcaggttcacatggcttgtggtgtttagagagagtcccatgactgaatataaccatttattgaagaatatcaaaaagagaattaacatgggaaaatgattagtatgtgcagtgccctgtgtgaactgaacatgttaggagaaatttgaattgaacctggttattcagagctggtcctttggaactggaagtacactttgcttttttgaagattgaacacgtccaagtaatagggcggtgtccctgcgggcatttcagatatttggagcttttatattctataatactatatgtctcctaaaatgtaaataactcttgtctgaactgtttgatagattctgaattaaaaaagaagcattaatctagaaatttggagatagcctatgatgccctttgcatgtatgatatattcatgtaatcagatactttgagattcaaaagatagctcattcaacagcttctttactatctatttttcatttatgtttcaccaaataaattttctctacaatcatcttttatatcctttctaatgaagatttaaagattacataaacaccattagcattttacctttgattgaatcagaataacacataaacatccaatttgatctcaaattttgaatgtaaagggaatccttgatattaagattctggtatatacagatggaatcctatttcaatgaggcagtgcaacatcattgctctagggatagaaagccaaggctggtgactctgactgtaccatgcatgagctctagactttgaacaggcttctttaccttgctgggggcctgacttttccatcttgtaaaaagaaagaatgaaactaggttgtctaataaatgctttctcgtagctcaaattcccaggaattctgaaacaagctcttaggaacaagtgtgtttccttatcatggctcacaccctacaacaacactacttggctgacatagactgctgaagaagaattctacaaaacgcattcattcacatttagcaggtagtctagtaatccatttgccaggtatgttgtgcttttggcaaatatcaactaaaagttcctgtagtgtaataaacattcttaatggtaccagacacatttcaaggaatttggagttttatagttttcccccctttggcaaagtgcattttggctgatgattaggccagtaaagtctgtaaaatgataggacccttgtgagcattgggtagcgacatgatggaatgtgcttggtttgcttttgcagggtcacagaactttgcagagaacagatggccccaaacatctttgaaatgctagaaatgacttcctgaataaccacatgcccatcatatcttggtccagcgatggtaattcacaagccaaacacacagcactttacagctgacctccaatgtattatttttagtctatggaatgcatgaacattttctacatgaataatcataatgataactggaacctggaagagcaaatacccatccccgaatcactgagccattgaacacttgtcagatgagcaatgacattcttagaatctataggggcaggaggctaagcatttgaccgactctcagggatctctgcttagcaagtcacttcatctcatttttctcaagagtcttgctcaaattgcatatttaaagagataagcagtaaggtactagattaaagagaaggtaaatgaggtagtagctgattccattccagtattgtttgggttgtgggagggaagcctactggatgaatctgcaaactcagtgaaaccagtctacttctaaagtccttccaaagccccatgttgagtcagtgtatatttaaatgccaaaactaaacaaaaggcaacctatagatgcctactccaaatcatagactttctaaaacattgaaagaattaatttaaaataattcaactaagcttcatgctgttagaggtgactgatgaattttacagaccaggtacacccaaataaaaatctgatgaaataaaagtctggaattggagaaagttgaagacttttaactaaaaggaaaatgaggggtgtctgtgtgtgtggggggggcatgtggtgtcaactgctagatttgtcccaatccccccccaccacacacacacacacacacacacacacacacacaatagatagctgctacttatttaacgcagctctgtagtcaggcactttgcagagaaccagaggagtgagtttgtcgaaatctcatttggcaaattggtgtgtgtgtgtgtgtgtgtgtgtgtgtgtgtgtgagagagagatagacagatttttataaaaagagtgtgtgaaactttggctaccccacctgaagccacagacaaacagccttatattggggccactgcattccataattattattgccattaggaataattattatttgcttggttgagttggcagtttggagcctgcctgagacagaggcttctcaaaggagccacagaacacaaaggcccgaccaatcacccacaagtgcttcaacatgtttggacgatgtccttctcttggttcatttcattgggtttcatacccattgagcttcaaattgaatgaaaactgcatcagatacaaaaccagcatgaatgagtgctggtactcaggaagcttttttgattggaggtctgaattcttggcttttctcaagtctggagatgaaagttaatttttttcatgacactgtgttcctctaattaaaaatagaaaaatgaataacaagatgggtcttcagttagaggctaggttcgaaacagtctgagagacaaagtgcagaagagtgaggaaacccccagccaaaaagcagcaaggctgtttaggaggcagaacagtgacaacttgaactttactttttcccaatgtgtttaaccttcttgcacacaaactccagattccagattttgtattatttcttctttcctttgctgtatcattttgaaataactgtgcccgaatattcctccagccttctttagggatctcagagaaagtgtggccaggggattttttaaccagcggagtgttcacaacagaagctgcgcctggtgaaaaggctcaccaagccattaaagagaaaagagtatgacaagacattcttccagacgttatttttcccgtagacttggttggttccttgccaaggcctgtaccacagtcacaggcagaggcctgcgggtgcttaaagagaatcacaaacgccctcaagtatgggtgtctctctcctcccctttacctcttcctcccatagtggttgtttgtagctcaagtggttgaatcagaccctcaagagcttcctaagaaaggctgaatcagaagaaaacacccaacagcctccagttattgtatcaggcccactacagtacagtgaaagttagctttgtctccacaggcacccaaacaatctgtcaagcatcgcaaagccaactgtgatttttagacagggcagggaagacccgggtgacctcactagaagcaagggaggcgccatgtctgggtaatcaatgccctgtctgcctgtcaagaatgcaggtgacttggtgcacaccttctcacagatgtagtgccagggtggggtgagaaagaagaacctcctctcccattctaggcattggaaagatacttcttttgctattaccctttgcacaaaaggttctttgggtgaatgcccctgtacgaataagaagtaaatgaaagttgcactgtagtgatttccggggatttgtggtcctggatatttatatagaaaaactgtttagtgggaaaatattgcaaaggggcattcctgtctgggtttttataaaaggtgacaaaatagtgctgtaaagaaacagaaatcccacactttctcagtagtattaaagcctgtccttaggtaaaatttcatgggagtatagagttgctgctttttcgtttttcatttgttcttggaatttaggggtagagaaaggccaagggaaatggccttcatcagcaaggagtttaataaagacagaactttaatttgttcattctcaatggtaaccttcacggggaaccacatttttactaagtcacagtagtgtattgtttgtatcagttcttaatgagttccattgttaacttttacgtcaaagaccctgttgcatcaacttctttttagtcttatgataggaagcttgttttcaaggtgtttccatgaaaagcatttgatccttcatatttccgtggtggatttctctggaaagttgggagttttccaaagtctaactgttatatcagtttttatggtgatgggtctcatttttcttgtagtatacattatcttctctactaattgacttaattttcagtccttatctccagtcaagaaatgaaaagaacttacaaattttgttaattgtactgaaattagacgtgtggtgagttttagaggagcgtccaaacagaactggattccatcagagccttgaggaaagttagacggcagaccccaagggagaagagggcagaacacaggctgacatatgacaattcttgggaaactgtttaaatttcttgggaaaaacaagataactgatggtttttttaaaattaaataagtaaatagcaggcagatcccagaacattgtaatgtgaaatctaggtgccataatataaagatgaattattaaaatatgggcacctcgaatccactaacttgggcccaacagagcctgcccaggggctgccaagcatgaggggtgtggagattggccaggtgggcagggctccccatttcccaggtatgtcttcaaccacagcagcttcacatatgtgaacttagttgggtttccacataagcatttctttgaacaaagggctcttcagcaagagcatagtttgaaaactacaaaattggaagatgcttttttctctatgtaccacaaacaagaggaaaagtgaattattgggtatgataaagcaagtaccatcttaaagatcaatttccgggagaaccagtgatgccatcatcatcatggaaagtggatgagattggacaggcaagctgtggcttctgaggtgataggtgattgaggggagaataaaacatgaaataacttctagtatttggatgcgagggaagaaaatcatcagaagggaaacatagagacttgatggggatctgtccatttcaatctctcaggaaagggtagaacaacaataacaaaggaagttgtatcatttcagtctacccttttaggcagggtacacttacacatgattgcaagaaggtgcccacagcactgagcttcaagaggagcagagaggcagc

SEQ ID NO: 3231 - DNA, 2647 bp, Homo sapiens
gttccaatgagaatgaaggctgaggtgtgcgccttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaatgcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcaccgctaaagaaaacaaaatatgctgccactaatttgccaccaccctgtgagcatgattggatgatgtttattttgattaggagattgctccatttataaatcttcaatacatcctgtccccctaaaacggcatctgggtcttttgagggttaaaaaaaaaaaaaagtgaaattggatgagggatgagagctggacttctgtgtgtcccggggtccctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaactacccggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttcctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggcaggccagaaagcagacccagggaggatagcacatgtcttcggctacactggtgaaggcatcgtgcctgctccacagcacatttttattcaaggtattgtatttgcaaacaaaaatgaagtcccacaaatgcgggactccacctgactctcaaaaagaaaataaatcacaagtgtattttaaaagctacatttgagattagcaaactggaatcaaatgacagatactttatccagaaa

SEQ ID NO: 3232 - DNA, 589 bp, Homo sapiens
tgggaatcacgtaacatttacaatccacttctatgcaaggcagtcttgtgctaaagaattgctaaaagagacagtgccttttgaatgcaccatatgtgttattcaaaagcagtggcaagtcgaagctcctatcttaatcctcgcttgttattatgcctggatccaacttttgaaggataagagatttcacagatcattgattacaaaggcaatagccaacaccaacaccccagacatgagagggatgctaccttcgatgcagcctccctgcccggccccagtcaagccaccgatgactgctactacctgagcaagcccaggagtgggactggtggctctgtaagaagaggaggaggcacctgagctggcacactcagctccttcaccatgtgatgccctgcaccacctcaagactgcagagtccttaccaacaagacggcactcaccaaatgcagcccttagaccctggacttctcagtctttttaactgcttggttttctatcccaagatgattatttcacacctgttttgtctcctcaaacttcatcctaaggtatccttggttatcctttcagctgaagacttcgc

SEQ ID NO: 3233 - DNA, 1375 bp, Homo sapiens
tgccaagttcagctgcctgcagaagcacagctcagagccgtccctataggcctagtccttgcacaggtctggccaatcagagctctgttaccaggcagagcctctctctccagctctggtcactgtcagcctagctgtccaggcacccttctgcaattttcgtttgaattgatttttttaaaagcacctgatatacacttttcttcttattcttctccttctagtcctctattcaaggccctaccacagagacacacaggaacggaactcagaatcacaaacaaagaaactttgatccaagaaagaaaatgatctttaaaaagaccctcgtttcatgctggccgatgctgagaaaatctgctctgaaggatatttggagacactgattaaaagatggttgtcccagtggagggggattcttcgtgttacgtagataggaagcacgatgcaaaagtgttgaagcaggagtgtaaagaataattaaaacacctgcccaagacccaagcaaggataggatttcccagacattcgtgagggagaaaatgccatgtcctttccttctggtgtcacatcagaatctgaaggctgctagagaagggagagaaacatgaaagtgagtcccatgctgattgttgttgaaatacctggaaagaaactggcaaagactatccaagggatgctaagacatgtccgaacttacaaaacagtagaacctgaataggaatttgaagttgtctatactctcctcagccacaccctgccattttacagattgtcttctctggggaagttagctgtcatgttgtgaggatactcaagcagtttataaagaggttcatgtcgcaaggaatggaggcctcctgccaacagccatgtaaaggagccatctaggaaatagattctccagccccagtcagaccttcagatgattacagcccctaccaaccttctgactgcggtggaaggaaggttccggaaccagaaccacccaggaaacatctatgaagtgcctacttgtatctgaatgatggcctggaactaagaagactaaaacatgactcgaacttgagagaccacagtctggtgagaaacataagtggacccaaaaagctaaaacacaatagcaaagaaaaatgctacaatagggtggctaaccaatggcgaagccaagcatagtggagtcagactccctcaattcaaacccaggttctgatgcttattaggttgcaggatctttttctcaaagtctcaattttgtcatctgtaatagtattgcctttatgaaattgctataagggattaactgagataatgcatgaaaagtacttgcactgtgaatggcccatagaaagacttttaaaatgttaattgacac

SEQ ID NO: 3234 - DNA, 14417 bp, Homo sapiens
cagtggcggcagctgctggcccggcactgccccgtgccagctcgctaagcacttggtcccagctggagagacttgataggactttgccgttctgcctgccacagctgttcacttctcaggaagggagtccagaagctatgtggctgcctgtgtggtcagacgtgggtgagaagatgaggatggatgcttgctcctctcatggaaacagataacttccgtacctgccaaaccaatggcagaggagctgggaagctcacaggcattgctgaggcctttgaagatgttagctgagaaaggcagaccagccagcatggagctgccctccctcccactcagcgcctttcctaggccaaggaccaggtgaagccgccttgaccctgatccagccgcctgggttgctgctgccggggaaggcaggcctggtgtggacggaccccctgacttttcaagacacactggaggtcactgagccatgttttgagtcagttctgcatctcatcaagacacaggtaatcagaagaggggtttggaaactcaagagcacataagtgaacaaaacatcaagcttgctcttaaaagtttttcaatcttacgcatgttgaaatggcctcactccagtcttgctcgaagtctgctgggtaaactgcaagttctaacagactaagaggaagtgcttcagtcacctaaggtcgtattttattttgtgcttttccaagcagtgggattatgtaatcacctcgcattgtagcagtcttgctgttcataatcttgctattcatgcagtggggtatagagaggcattaatttaggtcttcatggatctcctgaatccgcaatgatcatttgaaagaagaattccgagcagcttagtggtagagataagacccaacattactttgctgatggaatggtggaggtgtccttttctgctggtccccagataagtaaggagaccccaggggtgaaaaaaccacaggaacacagctcatccccaggaaactggtggacaaatgagcaaagatatatgtgctagggggtttaacataatgctgtggaataaacagggaattggttgaataaattattatacacccatacccatacaatgaaaaactttgcagtcattaaaattgatgtttttctataattaataatattgagcgttactgataatataccattaagtgtaacagaagaggttaagaataattatgtagactagattttcattataaatacatatgtatgttttttatctagggaaaatgttagatgactatatgccaatattttagaagtggttatctctaagtggtgagatttttgaatattgaaaaaacgctttttttctaagtgcttagctgtgttctctaacttttctataataaaataattgtattgcttattaaaattggacagttagaaaatgaatgaagttggtggatgagaggtaaaaggtatgagaggaatttagaaagtaagccaagctgagtaggataagcaaactatgcaactaacttttttggggaaggtgttccctacctgagaaataagcacgtaaaagctggatgagaatgggtttctggggaatgacccaaatctgttagacccccggggttgggtacatcagggaacaataattgttcctccatacttcttcctctcaattttccattgtaatatcacatttttctgggtacatgactacctggaatattggtcacatttttagcctttctggtgattaagtccaggccagtgtgggagtaagcaacctttaggaagcatccgtccggagttttcttttcctctcctccatcttgctatgtggaatgcagacatgatccctagagctctagctgccatcttgaatactgaggacgagggccacacctaatagggaaggggcctgggtttcagagcttccacacccatcctggattacttcacatccagacttttggtggagagctaaataaacttccaccttgctgaatgaactgtgaggctttttttttattatttatgaaaaacagaaaagagaaaaggaaagaaagggagaatgagaagataaagaagaaaagatctaagcccctttagatttgcataatgataatatcaatagctaacctttactgagtgcttctttcttgtgccagattctttgctaagtgctctaattctctttgctaagcactctctaattctcacaacaatctttgaggtgtgtattatttcaaatgtcaatttttagattaaaaaactggggatcagaaaatgatatggtttggctgtgtccccacccaaatctcaacttgaattcccacgtgtttgggaagggcctggtgggaggtaattgaatcatgggggcaaatctttcctgtgctgttctcatgattgtgaataaaagtctcatgagatctgatgggtgtatcaagggtttccgcttttgtttcttcctcattttctctggctgctgccatgtaagaattgcctttcacctcctgccatgattctgaggcctccccatccatgtggaactgtaagtccaattaaacctccttttcttcccaggctcaggcatgtctttatcagtaacatgaaaatggactaatacaataaattggtacaagtagagtggggtgttgctgaaaagatacctgaaaatatggaagcagctttggaactgggtaacaggcagaggttggaaaaatttggagggctcagaagaagacagcaaaatgtgggaaagtttggaacttcctagagacttgttgaatgacattgacaaaaatgctgatagtgatatgaacaataaggtccaggctgaggtggtctcagatggagatgagaaacttgttgggaactggagcaaaggtgactcttgttatgtttcagcaaagagactggcagcattttgcacctgccctagagatttgtagaacttcgaagttgagagagttgatttagcgtatctggtggaagaaatttctaagcagcaaagcattcaagaggtgacttgggtgctgttaaaggcattcagttttataagggaaactaagcataaaagttgggaaaatttgcagtctgacaatgtgatagaaaagaaaatcccattttctgaggagaaattgaagcccgctgcaggctgcagatatttgcataagtaataagctgagtgttaatccccaagacgacaggggggtggtgggaacatgtctccagggcatgtcagaggtcttcatggcagcccctcccatcacaggcctggaggcctaggaggaaaaagtggtttcatgggccgggcccagggtccccgtgctgtgttcagcctagggacttggtgccctgtgtctcagctgctacagctgtggctgaaaggagccaatatagagtttgggccatgacttcaaagggtgcaagcctcaagccttggcagcttccacttggtgttgagcctgcaagtacacagaagtcaagaattgaggtttgggaacctctgcctagatttcagaagatgtatggaaacacctggatgtccaggcagaattttgctgcagtggcagggctgtcatggagaacctctgctagggcaatgcagaaggaaaatgtgaggtcagagcccccccacagagtccctactagggcactgcctagtggagctgtgagaagacggccaccatcctccagaccacagaatggtagatccactgacagctttcactgtgtgctggaaaagctgcagacactcaacatcagcctgtgtaaagcagctgggaggaaggctgtacccaagctgcccaagaccatgggaacctacctcttgcattagcgtgatctggatgtgagacatagagtcaaaggagataattttggaagctttaagatttgactgccccacttgattttggacttgcatggggcctgtagctcctttgttctggcctatttctcccatttgaaatggctgtattcacccaatgcctgtacccccactgtatctagtaagttactaacctgcttttgattttacaggctcgtaggtgaaagggacttgccttgtcttggatgagactttggactatggacttttgagttaatgctgaaatgagttaagactttgggggactgttgtgaaggcatgattggttttgaaatgtgaggccgtgagatttgggaggggccaggggcagaatgatatgatttggctctgtccccgcccagatctcatcttgaattcccacatgttgtgggagggacccagtgggaggtaattgaatcacaggggcaagtctttcctgtgctgttcttatgatagtgaataagtctcatgagatctgatggttttaaaaagaggagttcccctgcacaagctctctctccctgctgtcatccatgtaagatgtgacatgctcctccttgccttctgccatgattgtgaggcttccccagccatgtggaactataagtccaattaaacctttttcttttgtaaattgcccagtcttgggtatgtctttatcagcagtgtgaaaacagactaatacaaaaaatttaaaagttgcccaagttcacaaagctagaaaataatgaatttaggatttgaactcagtatccccaagcccaagcctgcaattctctttttctttttttgagacagggtctcactttgtcacccaagctggagtgcagtgtcatggtcttggcctctgtagcctcaacctcccaggttaagtgatcttcctgcctcagccccccaagtagctgtgactacaggtgtgcaccaccacgcctggctaattttttttgtattttttgcagagacggggtttcaccatgttgttcaggctggtctcaaactcctaaggtcaagtgatccacctgcctcggcctcccaaagtgctaggattataggcgtgaggcattgcaccaggcctgtttcttaaaatataatctgtggtttccccctatgagaatctgggaggtgttaaaaatgtgaatgccttgatcccacccctgactgatttgatcagaatctcctggagtaggattcaagtagctgcatttttatcaagctccctcaccaagtttgatgctactgtaggtctaagctatatcttattctaactcaaatgggggcaatgaatggagttttgacataggctataggctttgtaaattgctagctttctttctttcttttcttttttctgaaagatatttgcagtgcaagtagcttacatattttaatgacttactgagagagcatattaaactaaaattgcacaaaatgctcaaattgctttgaaggtgcctcaaccttgaaaccctaaaatagtactaattgcctattttcatcttttctccatctcccctcaacataaataaatattgtgcaaatgaattatatatagattctattgttaacaagaagaccctctttcttctttttctccgttttggataatccctcctctggtagtctcatttctatgttcatactcacagaaaacattggcttccatagtgcaaagcagggcagagggaagcaggaagcagtggagcaaggggaagagagagggagagagtgaatgactctgaagaggaaaggaaattaacatttattggggttctgccaggccacagacatttttcttacattattgcactactgcactttccatgtattatctcattcatatgctctcaaaaccctatgaagtagatagtattatcctattttatgatgaggaaacagaagttctgatatgggaaatgtcaccaaacaaggtcacacagccagtgtattggcagatccaagattggctgaggctcgtttgacctgaaagcctgggtgtttttaccattcttattgtctgccatccacctgaagtcacctagcatgtttttccatcataaaactcatttggggctctgttttgtaatcaaaatctgaatcgaatgtgaatgcaatttgcttgctgctggttgtaatagcatgaattattgaactctagagctctcacataaaagttaagcatctgaagagactcagctggttgattctatccagtctcccactgctctctcaagggaaaaagattccaagttcaacattagctctcacctgttgtattgttggcactagcttttctcacccatcattgttttctgtctctacagatgcaggggcgagaaggcacaggaataaagtttgtgtggagatctcacagtcaggtcatcaccaaactctttttccttgtgtatacctaaaatgctttccttttctgatatttaaaaagctcaagactctatgcttttgtaattcacctattcatttgtctcctcagtagggtctggaagccacaagaggaatcattttgatagaaagataatgcataggcttcagagacaagagcttgcaggcactttagcaataaaattatgttgttgctttgccaagcatccccttctgtgaggaaccacctgttctctccttaccttctgataggcaggttattcaccctggccacatcatacacacaagggtacgtgggccaggctagccagttagaatatcccaaaccctcagcacagtgatgaggcatgtgcctcaatcagggataattagtattttctctgagatttgatatacagatactgagaaataatctctattgcttttgaattatgagccttcaggttgtggactttggaccaccagtgcaatatagtgtagttcaatgttggctattatattggtgatatttcccaaccagtagacgcactttcctgaaagaagctgtagaaggcagcagaactagatatagcaagctagataggtaactagatagctagagccctgacaataaaatctgaactcctagattaaatggtgcctggttattcagttagatgagatctccaattctctatatccccaatttactgttgattacttaaattacttggagttattttttgacacttgaaactggaccagtcctaaccagcacatatttgaaacccagaaacaaccaacttcataaaaatgtaatatccaaatagcaaaattcagaaacagcaggacgttcagctgccagtgagccctgagtttatttccaattttaaaaataaagggaggtaaaggctgataacagggtaaaagaaaaggaatgtaagtggagtagaatcaaccacagtgacacatacaagggaaaaagcagagctgagatgagaactcaacctgctactgtgtaataagctctttgacacaccctggcaatgcttcccaccaatttagaaaggttggcctggttctctctactcctcgcatcaggtgggaccaacatcaatatgctgagctaatggcttatcaatggtttacttccctgagctggtcatgagattgcccatcactggagaatgcagcccaaaaccaaaaccatcctggcctttgactcaagttatgtatcatttcccaggctaagttatctgctgctggagaattcaggatttgtgtctgaagcatctctgcctctctatctttgaacactgtacacaagtaggtgtttaagaaacgcttgatgaatgaatgagtgaattgctctgaaaacattcaggaattactgttctcagatacatagaatgcatgcaaggttaatacaaatggctgataagaattactcaagtgcagatctattggatgagctagggaaaagaaggattgttttcatcatgttttctaaacatcccccaattttaatgatttggtgttatacacacttacacaaaggttccatactcaaaaagttaggcatcactgaatcagcaaaatcacacaggtttctttgctgactcgcttttcagaagttttattttgtgaacatgatttgcataattgcatctggggcactttgctggaagagcccacgtgtcttgggaatgctgggcaagggaaatgtaactttccctgtgggttcactccactgataaggtaaggggtcaaaaattgtactgtaccctaactttgtagttgctgcttaaccaacgaagccactgtgcctccttcgctcatagtgataatctttttggagcagatttgttgggggaaatagagtaaatattagaaagggctggttagcccttgtgtatgttttctcttctctgataaggagggagacactatgcaaaccccagtgctcacccaacaggaggatcagatccacctggccttggcaaatcccagatgatccacttctgggtgcttgagatcagcagaaagctcacagtgatcttaccaagtggaaatccctaaatccgacattcagatttgagaccagttttataagacactctgcgtgagttttttgtttttgttttttttcatagaaaactttacttcaggagaggtactaggatgcaatagttaagaactcatgttagaatcaagtgggatgttggtttgcattctggcttttgtaactttggccaaaacatttagcatccctgatccttagtttggaccatccacaaattggggctaatactgttatttccctgtgcagcaaactcagcaagtctgggttatccaaaccctgcatattctgacaaaagttttggctcttgcctgggagataacctctaagtccttagaatattttggctgatcagagagattttgtctacctggaggccttgggtcacacgagatagtctaagctaacaatgtgacttatggtgggggctctgggccaaacggtagaagcttgacctctggaggggctggagactgagggcagccacatgggtggtctgagatggtaaatgtcatcacacaatgaaatctccagtaaaatcctggacagcaagtctctggtaaaaagaaatgctgtctgcatgactccactgggagaggacaactggaagctttatggaagctcctggactctgccctaatgtgcctttttccactgctgactaacttattttctttcactggaataaactataaccatgagtataatggctttgctgagttgtgtgagtccttctagtgaataactgaaagtgaaggtgatcttgggacccctgagcacacttcctcatggttttggagacgattaatgtgataaacaatgtagaatacttagtggaatgcctggaaaataataagtgctcaataaataaggaagcttaggagagaggggtaataggcctgctgttatagcttctggtctgacttcccagctctagtcatcattcattccttttttgctttcaacaaatatttttttgagtgccgaccatgctaggtatggtcaagacccttcatggagcttacaatctagttgaggaaacaaagatcagacttataaacacacataaatatataattgcaagctggagtaaacgtgatgaaggaaaagaattatgttatgacctcatgggaggtcagagacttgagggatggaaaggaacccaacgtagggaagattctctttattagctgcttatttatatctgaaattctgttatgtcgtgtgacttttgttatgtgtttctctctttatttattttaatgttttctccgttgtatgttctcactgatatgtgggagctaagctatgaagatgcaaaggcatgagaatgatacaatagactttgggggcttcgggggaagggtgcgagggataaaagaactcaaataaggtgcagtatatattgctcaggtgatgggtgcacccaaatctcacaaatcacccctaaagaacttacgcatgtaaccaaacaccacctgtaccccaataacttatggaaaaaaatgtaaaacagagaaaaaatattttcctgttttctcattcctggactatattagcaagtgtctctctctttctctcccctcagtcttttgctttggcctctcttcttccagtctttggtagaatgctaagacatcataggctcccttttccttctttacctaactcctgccactttgagtctgtgggcatgacatcccttccttccttcttcaagccaatatttatcaaacactcagaatatgccagcctttatctcctggtccctccttcatcagttccagggttctgcagcagggaaaagggaaggaagtaggagtttacatcacctgggcagagaaagagctgcttatagtcagtagtgccttttcagggctgccattggcgtattttcattttttcctccaaacatttccctgagatttctttgaggtgatctcatttccctatcctaggaggtaatccaagatatgtctagagccatatccctggctccaaacataagctggttctcaataaatagcttgggattgtttttgaaatgggctagatgccaatgcccagagctgttcaatgggataggactgaactccccagggaagcaaaagatttccgtcaccatctcttctccaccagggcacagggcacctgtggagaagggcaaggggtacgtgggagcctgaaggatgagggaaagcgccatctcattcggcctgggaggcaattctgccctctttaattatccccctttccagattgagcttttccaataggtgtggcacgtggtgggtgagtctttttccatatggtttgagaaactgagccaaatacaccatgcagagtgagaaaaaaatgagtcaaacaaccctcccaccactacttctcccctggcttagaggaaaagcaaagctctggttgctctaccccggctttctcctcggagaggtttttggagctgaaggaggaatgactaatgacgtggaggtttctcctaatgcaaccagctggcctgggggctggaggtggcccctgaacgtgatttacaacttatacactgtgtccttgaatgaggtactgaacctctctgggcctgtttcctcaactgcaaagtgaagaagatgatttttaccattcttcccaactctaacgataacagacatttatttatttatttatttatttatttatttatttatttatttgagacaagtcttgctctgttgcccaggctggagtgcagcagtgcaatcattgctcactgaagcctcaaactcctgggctcaagagatcctcctgcctcagcctccaaaatagccaggactacaggcacactccaccatgcccagctaatttttatttttgttttgtagagatggggtcttgctatattgctcaggctggtctcaaatgcctgggctccctcttcagcctcccaaagtactgggattataggcatgagccactgtaccagacccagagctttttaaaggtgaataatgaaagctccagaagtatctttaaaatacatcagaaatagaggtgacaggtgagatgaaaccaaattggcaaaatggtaataactgttgaaactttagtcatgggtagaaggcagttcattacattctctgcttttcattattctatagagttgattattctctccacttttgtgtatgtggtcctcctcaaaattgccagtgaggtaaaggtgccacaagctgataggctgtcgtgtgaggaatgaagtgactgtaaatactcccaggcccttggggagaatgaccttgaagagaagatctgaaggagctgggcttgtcctcaattgtcaaaaagttacatcttgatttcaagtggtttacttaattaatctccatcttttaagatttacaagtttgtgtgtgtgcgtatttatacttatttgcagtttaattttgtgataccaaaagaaaaagcctagcatgacccttgttggagaccacaagccctgggaagttggacttcttccctctcagttcagttgtccctgaagccaagacttttttcttttttgagacagggtcttgctctgttgtccaggctggaatgaagtggtgtgaccatggctcactgaagcctggtcctcctgggctcaagcgatcctcccaccttggcctcccaaatagctggggctataggcatgtgccaccatgctcagctaattttttaatttttaggagagactgggtcttgctatgttgcccaggctggtcttgaactctgggctcaagccattctcctgcctctgcctcctaaagtgctgggattacaggcatgagccaccatgcccagctgaagccaagatttttaatcaccaagaccttctgcaaatctgaagtttgcctctttcaaataaaaattcagagcattcttctcatttataccaagtgaaatagacatgaccttggagaagaagtgccctgcctgcctatagagctgaacttcatggaaggagcgagtggctgtgcatcagaggggtgctaaagactcacacaccatttgtccactggacataaggtcatttctttcaacaaaaagtctgaacttagggaaacctcctgaaagtctccaagaaatgggaaagatcactgatgggtaagttatagaagttatttgcaatcatttttcactctgagatagagccaaaagtcttccttaggaatatgagatatggcggaataagtgacagttctcttttccataaggttttatccacataggtgccaatatctttggcattgttcgctgagtcttttgtatctttatcttcagaaagcctttcctatctccttccccaaagcctgggttgggtcttcctcttttgtaagccattgcaccctatacttcccctatcataacactcatcaccctgtgttgcaactgctgttttacttgtctgtctgcacaccagattgtgagctctgtagcagcaggctgtatgacttattcatctttatacttgctacgtctactcattcattcaacaaaaaagtactgagtgcctacaataaatgagacatacacaatacctgcctttatgggacttatattctagtagcatctagtaagcactcatttatttgttaaacaaacaaatggaagagtaaatcaataaatgaatattaaatcacactatgccagttaaacccaacccaaactttggtatttagtcaatgctactcttaacaaaagaactccaacatacccaactagttatttccccaagattggggagtatccaagcatgctagccaaagataaatatagtatttttctaggccatcctttaaaaaggctccattatttaaaacatgccttgagctatatctacatcccagtttttccagtgggtacttgccttggagactctcgcttattgaagactttttctttccaacatgccctctgtactgagtgtataatcaccactgcaggcaaccatgatgagtgacaaaaagtgccagctggcagctccagcaaagggaacaggagagagcaaggaggtatctttttctgcctattcagaacattgaaacccaatttatcgctggcctcatgagccaaagaaagcagctctcagcagctgttgatctgagaggctccaatctcatttccatgagctgggtgtcattgacactcatctggcttgtctgggaatgaattggcatgaaggagtcttcctcttttcatccctgaggatttgggtgggcctgttacaaatggcagaaagagttatatggtcactcttttgaaaataatgccaaagactttcttgtttttgttgtgggtggacattccttaataactactgcctggggggttctactcttctcattgctttcaccctcactcagtaaatgctggttttcgccctcactcagtaaatgctggtaagtcagctctcaaaaaaaaaaaaaaaaaggctctggtttgtagcatttgccaatttccctggtataaatactcctattttggctaccaacagacattgctgaatgtgaagttgggaagagatgtgccctattgcctgctaagagctggtagaagctggctccaaaacaccactacatagctctctaattcacacttgctccagagtgaaagactgcttctggctagcaccattgcctttctacaactgggattttaggatacagtgtattcttttgcatctgctatgtcactgggctctaatcatgacattgcggggtattattatgcctatttggtggatctagaattcttaagatctagaataggtcttaagaatattctttctacactccaccctctccctctcctgcccaatcgctacttatcttttaggtctcagcttaaatatcacattcctgaatgtccatgtcagggtcaggtttccatgtgcttttatgatgctctcacatgctctcatggtggaatttgaccagtggtgttgaagtggcttgcttatttatctgcctccttcactgactgtaaactttgtgaggacagaaacttctacccagcccaccactgatctcagtgcctagtgcagtgtctggcccaataagtattgtgaga

SEQ ID NO: 3235 - DNA, 709 bp, Homo sapiens
gagcgcctctgctcggccgctgtgcaaccctccaagtgtgagcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaatg

SEQ ID NO: 3236 - DNA, 23730 bp, Homo sapiens
ccccactctcttctggcttgtagagtttctgccgagagatcagctgttagtctgatgggcttccctttgtgggtaacccgacctttctctctagctgcccctaacattttttccttcatttcaactttggagaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctctccgtcactttcaggtacaccaatcagacgtagatttggtcttttcacatagtcccatatttcttggggctttgttcatttctttttcttcttttttctctaaacttcccttctcacttcatttcattcatttcgtcttccatcgctgataccctttcttccagatgatcgcattggctcctgaggcttcttcattcttcgcgtagttctcgagccttggctttcagctccatcagctcctttaagcacttctctgtattggttattctagttatacattcgtctaaattttttttcaaaatttttaacttctttgcctttggtttgaatttcctcctgtagctcatagtttgatcgtctgaagccttcttctctcaactcgtcaaagtcattctctgtccagctttgttccattgctggtgaggaactgcgatcctttggaggaggagaggtgctctgctttttagagtttccagttctgctctgttttttccccatctttgtggttttatctacttttcgtctttgatgatggtgatgtacagatgggtttttggtgtggatgtcctttctgtttgttagttttccttctaacagacaggaccctcagctgcaggtctgttggaatttgctagaggtccactccagaccctgtttgcctgggtatcagcagcggtgtctgcagaacagtggtttttcgtgaaccgcgaatgctgctgtgtgatcattcctctggaagttttgtctcagaggagtacccagccctgtgaggtgtcagtctgcccctactggggggtgcctcccagttaggctgctcagtggtcaggggtcagggacccactcgaagaggcagtctgcccgttctcagatctccagctgtgtgctgggtaaaccactgctctcttcagagctgtcagacagggacatttaagtctgcaaaagttactgctgtctttttatttgtctgtgccctgcccccagaggtggagcctacagaggcaggcaggcctccttgagctgtggtgggctccacccagttggagcttcctggctgctttgtttacctaagcatgcctgggcaatggcgggcacccctcccccagcctcgctgccaccttgcagtttgatctcagactgctgtgctagcaatcagcaagactccatgggcgtaggaccctccaagccaggtgcaggatataatctcctggtgtgccgttttttaaacccatcggaaaagcgcattattcgggtgggagtgacccgattttccaggtgccatctgtcacccctttctttgactaggaaagggaactccctgaccccttgcgcttcctgagtgaggcaatgcctcgccccacttcggctcgtgcacggtgcgctgcacccactgacctgtgcccactgtctggcactccctagtgagatgaacccggtacctcagatggaaatgcagaaatcacctgtcttctgcgtcactcacgctgggagctgtagacctgagcagttccttttcggccatcttggctcctctgtcccaaaagtattcagtgtattaagttcctggtttttcctctgtggatctgatcttcctccaggcttcctcactagagtaagtatatcctccattaattcacttgtccgaggcagaaatatggaatatggaagtgatcctaaaatttgtttctttttcttttttattttttttgagatggaatctcgctctgtcacccaggctgcatgcagtggtgtgaactctgctcactgcaagctccacctgctgggttcaggcgattcttccacctcagcctcctgagtagctaggattacagtcatgtgccatgatgcccggctaatttcgtgtttttagtagagatgcggtttctccatattgttcaggctggtctcgaactcccaacctcaggtgatctgcctccagaagtgcgaggattacaggcgtgagccaccacacctggctgatcctaaaatttctaagcctcaaaatatattttgaatatatctatttcacttcatcctcactgcatctcttggtccaagctgccatcttttttattagaactattttagtagccttgtaactggtctctctatattgctcttaattccttccaatgcatttgttatgaagaagccaggattattttttaaaccctaaaaaaatcttaaaatgccccagtgattttctgttgtatttgggatgtataaaagtagaattatatttaacacggctttttagactattgcaatttagtccctagctacttttgtgtgcttatcttgagccattctcccctctttctgacacactgtccttaatttagttccctaaagggccatctaagaaagttcacacttgctccctctggttgaaacactcttctttttgcctgctcatccttgaagtctcaaataaaatgttatttcctcattgaggggatccctgaaggaccaatttaaactagatatacctcattgctctctttcatagtgtgcagtaaagggttaattcagcaagcttgaggtgctcacattctgcacattccaaagaaaggtctgtttttagatcatctctggaagataacttctgagccttgggaatattctgcctgatatgaggattttgtatgcctgacaccttgtgccacacagtgccattttggttacacagcttatgctaacaatgtgatttatgttgagtgcctgtttttgctgagggaaccagagtctgagtagttgaggccagtggcaagtgagctacatgtctttgtttctggctccctaatgaaaaccctggacgccaagcctcaggtgagcttccctggttggtaacacctatatgtgttgttgtacatcattcctgagagggattagtacatccccatgtaacttcactgggagagacacctgggagtttgcttggctcctcatggaaattatcccaggtgcgttttccctttgttggattctttctctgtaacaaaccataactgtgagtgtaactgcttttctgagtcctgtgaatttttctagtgaatcatcaagcctgagagtgatattagagaccccaaaacacattgtaccttatttgtttccttaaaaacaactatgttcatttgtcattatatataattgtttatttactcttttttattttgcttacatccagacattctataaatgtagaaattaggcagtgaattattttgtttctcatcgtattccaattcctagcatagcacaacaggtgctcaataaatgtttggggaattaaaaattaaatgtaagataaaaatacatgaaagaaattaagtgaaagattaatttggaaaggttaaatgccatatgattccagctatatgagattctggaaaagccaaaactatgaatacagtgaaaagatcattaattgccaggggttggggagagggaggaatgaataggtggagcatacaggatttttagggcagtgaaactatgttgtatgatactgtcattgtggatacatgccattacacatttgtacaaacacatagaatgtacgacaccaagagtgaaccctcatgtaaactatggactttgagtgattacatgtcagtgtaggtttgcccattgtaacaaaggtaccattctggagagggatgttgataatggggtggggttgggggtgctgtgcacgtgtggggcgaagagtatagtatgtgggaatatgttctgcaccttctccattttgctgtgaacctctctaaaaagtaaagttatttaaaaactgaatgtacagtatttggtgcaaaataaatagctctgaagaactttaagatttgataacattgtcttccaatttgatttcaacctttaaatattataatttagctttatttcctgaataattacacatataattgaaaatagtcccagtatttcaatttgtattatagatttgtgataattctaataactgtgttttcactcagttctgagtttcttgtcaaacttgtataaaattcctactataatctttaagtttgttatggaggattttggagtgactgatgggatataaggaagagacaaaacgcaagcagaattattctggttggcttaagaaaataaagtgaagcagtaggtgatgagctgtcactggaaggagaattctaaagctgtgaagagcataattaattaaaggactttgcagcttgctcttgacccacattttaaattacagagagttagtaaaccaggactagaaatctccaaagatataaagcagaatagaccatagtttgacttacaaataggaagaacaggggtaatgaaaaatcaatttaggagcctaaaaagtctgctatagtgactgataagtagcccactgttttttacatgtttttgaatttatctctgtattctgagaaacttgaagttattttcccctggtcctatgacactgtctgcagttgatggaaactgatgtgggagaaagtgatggaaagaaattaggagctattggaaaccagtcatttgcaaatgagtgccctgacttctcagaatatatcctgaaatggtaatgtcactcatcttcctaattctaaattagacatgctctgttgcattggttgaaattcctactttccatctgtcgaggtggaggatgctgaagtggtcatgttttttttttaattaatatttttttgcatgtctggcacatgttcctcttagtcttgttaaacatctggttttcccattgaggatctattctttggccacgacccaggtatgtgagacttgctgacccaatcagatttgcacttgggaatttagatctagagtagaaatatcagccacaaactggttgtcctagttactaaatcctgaagaggcagccattaaattctgctgtctgtgttctcagtaatgtcataattcttcatttttttgctgagaaacatcatttctttgagtctatgagataccaaatacagacagagctggagcctcaaggttaaggagtgttaatctctcattgccaggaagagccacctcgtggatgacacatggcttgggaaatgtttttaggctggtggagatgtgtctaaacagatatatttttagggcccccttgtaatatctattctggcaatgatgcttttattctaattaatacataatctagcactgaagaaaatgcttcttagaatatttttcactgaaaaattggatgtggttactgttgttccacagtagagtgaattcagtgaaataagcttgtggattttggctactgcactactcctttttctattcactcattgtcattccataaacatttacagagtgtacactatatataacacactgtactaggggctgagggagctgctgctgggaacatttttatgtgagtaagatgatcagcttttctagatggaaacttaagggacttgaggaaaaagccatttcagacagataggaatccgtgatttttaaagacttttgagagattgtgatttttttgaagctatcttttataacagttccaaaatacagtctagaagttaaccacacaagacaacagaaaattcccctactaacttaaccctaattcttttccttaaatccatttatgccttttccttcattattgtatctaaagaatagctgattccttataataatccttcatatagttaatagtgttaatgaaaaaaatcctttacatagttaaggcagttactaagtcacttttcagcctttttttcccctccaggctaagtaatccaattatgttaagtttatgccataattaaactaaagattgctttaggaaagtttaatcacatcattgaaatatcccccaactaaaccaggtgcttgtcaagaaatgtggttagtgaccttgtaaaagctaatgaagtttcatattatatgttattttgtgttgtaaacacaatctggcagagacctcgaggaaacaaataaataaagcaactgaatcaaaaccattgtctctcagcgaggcttgacatttaagtggactatccaaagcaagtatgaagcatgacttattgcttaaaaaaaaccctgagcacagaacacttggtattgttgcaataatgtgttaaaaaatcaacttccacactgaataggtttgaatctgatgcacgcccagtgaaagtgtagaagaaacttagaattattaaactaagtgatgtcatgtttacgttactttcccatgtcctctgccctctgctagatgttggtgggtggtccagttgtggtactactttaccaccttgctatgatcaaggtatgtgtttgccataagcatctctatagccataattgttcttctattctttttttaagctacacaattcttacttgaaaaatagcaggtaggatttaacatgtcctctgtataacttagacaacatacatgtttcaaataactttatgtccatcagccttctttcatcatctttatttcctcttctggatgctatctaaaatagggaagaaggaaattattttggttgtccttgatttttatccttctgacataaacatgaggctgacctggaatttgtatcagaagctctgtgacctctccgtttcagctcttttagcttttaacaatttgatgttctgagtgtgaagactaggacgaaccaagagagatgcccagagggcaacatttaagaaggtcttcactttgtgttctgcaaaggttgactttgagagcttcctagcctgggccttcctaattttttcttttacacattaagtgtgcagtggatatacagacattggaatgtggttggaggagaagaatcatacttttgctgtgattctgagaagcctgattcatgtagtagtgagataagggtttcttggaatcaggagtgggatcctctgtatccagtctctgtggctaaatcaaggtctatattctggtccttatgattttttttttctcttctcttttgacttgtgctgatgttatgggctaaactgtgtctccctcaaaattcatatattgaagtcctcatctccagtacctcagaatgtgactttattacttcatttgtttgtttgtttgagatggaatctcactctgtaacccaggagtgctgtggccccatctcagctgactgcaaccccgcctcccaggttcaagtgattctcctgcctcagcctcccgaatagctgggattacaggtaccagacaccatgtctggctaatttttatatttttattagagaccaggtttcactatgttggccaggctggtcttgaactcctgacctcaagtgatctgcccaccttggctccccaaagtgctggtattacgggcatgagccaccgggcctggccagaatgtgactatatttagatttaggttctttaaagaggtcaagttaagcaaggtcatatgttgagccctaattcaatatgactagcgtccttatgaaaaaagaaagaggcatcaggattgcttccacacagagaaaaggccatgtgaggacacagtgagcaggcagcctctgcaagccaaggagagctgcctcaggagaaaccaaacctgtcaacaccttgatctgggaccttcagcctccagaactgtgagaaaataaatttctgttgtttaaaccacatagtctgtgctatctttttatggaagccctagcaactaatatagttgattatatggccagtgttactccaggaaagtcctggtatatgaacatctccccttcctagccttgaccatgaccttcctaggtactcacacatgaacacttagttggtgttatttcattctttactctttaacttcaaagaagctattctaggattaagaaatccctttatgggttataattagaatttgaggccaagctaagaaagacctctggaggcttttctttgctccaggaataggattgtaaattttaatggattggctcattgttctttaagtttgaggccatgctcagtccctgccgtttttacctacggtagaaaaatatagacttaatgtcattcttgaatgatgaactatgcctgtcttaaaaacaaaaagctcacagtttctataatgtacatttaatgattggaacaatttatttttccttccaattcttttatttaatttaaggttaaactacatctcttttctcttaaacacctgcaatatataaactccaataacaataaattaaaatgtttaaaaatgggccaaaagtacacttctttcaggaagtgattcttgaaaatctggcagaagtttgatggtgttgagagctggtaatgtatgaagaaacctaagactagtgactgttatcctaggactgattacactgtaactggctcaagtattcctatctacgaaaggagggtgttgccccgatcatttctagttctgtcatggaacaaaggtaaataaaaataattgaaaaactaagattatgtgttcaaatactaggtggctggccacattatctgaacttccagtttctcatagctgagttgaaaaattccaggagaacctctttctgatccagtaacagtctgagccaaactgtccaagcaacctatatttaagcacttgaaattttaccctaaactaagctttttagactcaaatcgtgtgggcctggaagggggtgtggtagggatggtggacagctgaagaacagagccctgagattgcctacagggacaccaggcctctgccttacaggatatggccgtcctatagaaggatgggatctatggtttctggatgtttgtattttctaggagaaaccaggcattcagatttcagtatcaagtctaattttaaaatgttggcaaccagtacattatttttagacgtgcagggaaaatagacctatctgctcttgtttacaatattctcatagttcccaaagtaggagctatgcaaacattcactgacactgtattcatggtgcatggtgtccgtttctgtgggaagcctgcaacagtgtttttcaaactgcattccctcagagcctagcagatcttctgtggctatgcaaggctactgatgtgttagcttccttttcctttttttttttttgactgggtttacaattctatttgaacaaaaggtcgttttggtcaatatatgtaaagtgtttacaatacttggcacatagcaagcactactatgtgttagctactattattagcaaggagtttgtaagacattttctgtagggataataagttaatgtcctaatgattctattacgttgttccaaagaaataccatccttcagtttcatgaaattcaaaagctttttaatgcacccttaaagtttttatgaaactttaaggtttcataaaatactgaaaaagtagctgtattttatctaagactttaatgtgggaaaacccaatgagagtccttgctcgtttgcaaccttacttttgctatgtttgcttttaaattaaaaaagaattttacattttcatttcttatctaggttgcccacagctgggctgacttgtgcgattttacctttgaatctgagagtacaaatacattcatcaatattctatttcccaaaggtatactaattctcgtgaataatcacaacaatcatggcaaatttttagagattataaccgaatcattcctctgcaactgctatacagaaagactgtgttagaagctggttaacttgatgatctctcaccctctggtcccctgacctacctttgcagtcttgaactccagcaatgaggagtatatcactttcttacctttcttgcatcattacctctgcccagaatgcctctcacatccctttgattgtcaaaattcattccatctttcagtgatggtttcaaatcttgccttctccaggaaacttttcttgctccctcaatattacaatcaccttgtgccagccctgctatttccttcctttgagacctcttaacagtttattcctgtatatttgaaggtacttataagttcttatgatgcatgtttgcataacttctatagctctgtattcagctttatgaaggaatgtagataaaccatgtattgtggagtaatattgcacataaaattaaatcataaacatccctgtatttaggcatagagtatagactcttggtaccttttactgtgaggtgtaaggccctccatagtcagcagttgcagtataacctcctacagtttttcttcaatcacattagaactatacatgcaaatagtataaattctacttacatcagacttgtttcaccagtttaacatgcttttctcttacttttattcttatagatggtgctttttcttggctctataaaataccatattcttagtgatatcttgagttgttggttagtttatggcacttaataaattccttttaggattaaatttagattgtgagccctaccgttctttaacattgcaatagtttcccacagaagggtggatgaatcttcatattcattttgcttttatatataaagatgaagtcatcagtataccagatatctagcttttattcccaatggtaacttgttacctcccaagagaagaggccacatagggaagcacctgggtcactcagaaggcagagggagtaagggggaaatataggtgggctagacttggacatttaggaggaacctgatggagtaacataatcacaaagtaactttcaaatgctgactgcccgatgtccagtaaagactcagagatgatacatgaggtaaaacatctctaaagccagtgtcatagcgtgtcatagttagctgggtcttctctttcccactgctcaggtgctcatacaatcctgtttgtctgggattgaaaccatttatgccttttgtcactgtatacttattaagtgacactttcaccctcaaaagtgtcccagtgtagataacaatttatatggtccctctactcataatagccctctatttcctaatttattggccttactatacctgtaatataataaaaaaactacattttcagatagtattatcatattgggttaatagagaagacttaaaactgattcattagctaaaaagctatcaccaaaaacttgtacattgttttcatatagataatttctcaagacaaaactccccaaattttggatctttgctttaaaaattggagaacttagaagccagaagattttaattctagattcaaatctgacattacattttatttgagcaactttctcattcttttggaatgatggattacttacttttaaaataaaataacacaagattgataaaaacatgattactagaaggataaaatgacaatgtaaaggaaagggttttgaaaataaaaggcaggaagtattattgtgttatataggaaaattagtgacccaatttgacaaaaagtcattctgttttcaccaataaagaaacgtataatcattttatgcagaaaaaatagtgaggcaaagttagcatagagaccacatctagggaaatacatgctaaatataaatgaataatgcacgtaatgaattatgcatgattttaaattagttgatgaaatagattcattatagatgataatgcaggatttctgatcctcgttttgaatttgataccgaagtaaatcattgtgttggaattccctctgacagcccttgcagtgtaaatctctccatgtagcttgttcaattcattcttcttaatgaggagggaggaaggagaatgctggcagcattacaacaaaggaatatgaaagtgaggcaacagctgtataagggattaaaatatggagaaagagcataacatatatgcatttgcttatgaatgaacatttttagcaaaagccatttacagttcagtgtccacatggccttgcagaatagggactctgttttcttgttggctgatttgagcctttccagtcagttttcccatttgttctacttttttgatgtttctttagttatctagcattttggtttggatgttttctattttccttggtttgtggccagttagaccagctggtggtaatgaggttgttggccagtcctggaggcagcagggagggtcatttgacagaatgttttccatagctggagcctgctttcaggattaatgacaagaatagcagccagtttttgttttaagtacctactaaatatcaggtgcttcacaagcactatcgaattggattcttataattcttctttgatttgagtgtttatctctcacatttcactaagcaggagacccaagcttacggagagcaaataatttggctcacgtcttatgcctagtaagtgactaagctagaaagtgcaatcagagttttctcactctatagcttgtgctcttcaccagcaattacttctcaaatgtttacctgttcagaaggagccacaagcaagaatagaactaaatgcatcagaaacacctgtcaccatagggaataaaagctaggtatctggtcagctgatggcttcatctttgtatgtgaaagactacattgttatttagcaccatgtatttgtgtctagacctctttcttgacctttctggtggtcaaaaagaaacaaatgaacaaacaaacaactgctaatccactaaattataagaaatctctgagaggaacaatgcctcaaggccatctactttcttgctatcattggaatatatttacttcttcaggaatgcatgcttttctctaccccaaatgtggacacaacttatagattaagaactccttggttgtgtctttggatcctttgacacctgtttcaagactaagttaagtttctttacctaatctaactaaagtggtgaccacaagtggaaattcctacgacatcaattttccgaaccatgcatttggcagtttacatttaaggaagtttattgctagctaaacatttctgcctgaacactaagtcctgtaaaacctttgaggaaaagggccatgtcatgttctttttgtatctctaacatatcagataaatgcttggtgcataggaggtgctcaatatatactgattactttggtctatctaacacccaatggagagatctggagagttctgtaaactcatcaattgatgtatgcctaagtattaatttgtcatagataacaaatttcatgttaccataaatttaagagtatttcatagcattatgcatgagtaactgaaactgcagaagctgtccctaattgtagcttaatgaattacaaaatactttattctagctgaggaggctgatgacaattaaatgaaagcatgaaaaggacctgggcttgatggtgagaaaatctcaaacttcttagctcctctgtcttctttgtcccaatatgcattccttcccagatgtgctgcacatgttaaggcttttagggattaatcaaagcgcatttgtttgcatttacttgggagtatgatagcctcaaaattccatatttagtgtatgtttgatcctctcagttcttcattgtttgtatgtacacaagcggaaatagaaacataggttatctaaggagcaaataatttggtttctgtactttccccctatcaatatgaagaaattaggtacagctttttgaagagtatgttagaagtcaaatgactaccattaaaaattacaggccaggcacagtggctcatgcttgtaatcccagcactttgggaggccgaggcgggaagatagcttgagtccaggagtttgagaccagcctgggcaacatgacgaaaccctgtctttacaaaaattaaccaggccttgtggtgcgcacctgtagccgcagcttcttggtaggctaaagtgggaggactgcttaagcctggggaggtagaggctgcagtgtgccatgatcacacaactgcattccagcctgggtgacagagcaagaccctgtctcaaaaaaaaaaaaaaaatcaaattataataatcaaatgatttttccattagatcaatgaattcagggaaaggtctattttgatttgttaccctgttgttgttaaattgttccctataattcagcctatagaatattttttcacagggctttctgaatgagacttgacagatagaagcttacttttcctctctggttcattacttatattgtctgtgtacttttccatctcaatccttcataaatgtctattaactgattccctattgtactctggtaaaagaatataattgaagtaatttaaaaaattaatggaacagaaatactgactatgtcccagtttgctgttaccttcccatacccttcagttataaatctatttcccatgcaccattactagaatcatacgttgtgaaactctgacttcatcttaggatgatttctttaagatattctattagaaacttctaaaaacatgcctctgagcataatgttttcacacagcatgtgtattattaatttttgaaaatgcagcctcaaaaaccgattacatttgtcacactgtgatggaaacatttactcctggaaatggtgttaaggccatcaaggcaagctgcctcagaagctgagccattatcatcaccttgtctgtatgtacatcctctcctgccagctaccagcttttatcaggttagtgagtacatgagaagtcaatgacaacattaggtttgcaaaggttcatttggaagttagcattttgtttgagcccttctctactctattaaagccaacatatacggctaatatttcaatgaatgtgatcttagctccaacctttcctctgcgcctggcctcctcaagtcttttcaatctatagtcccacttgtttctacctgtgctcaggcaatttcttctgctgacccatcctcccaccccttcatgcaacatatttctaaattttggatatatgcctgtcattcaacatgcaactcaattgctgcacctcctgagaagtatttgctgattctcacagccagaattcatttattcattcacactctagtgtctttggccgctttaatctgtacccttaagctattttataaagtatgtagcagtgtaacctacaggagagtgccttttgttttaatggcacctaggatttgttttaataatatatagtaagacactcagacacagaaaagattgccatgaaggaagaactgtttattatactcacagttccctggaaataggaggcacaaccctccatgcagggccacatggggaagcagcaaggagagaggagaaggcagaaggtcgcggggagaggccttagtgggttgaatcctttattgtggttttcttgggaagaaagaagtgaagcaaggtaagcaggcttcggattggttagtttgaatgatttttgtgggccctgggctataagggctgtcctggttgttaccttgccctgtggtgactaggtcaggggagagaggtgtgagagctgatacaggaggtagctagaggtaagggctctagattggttggtttatgtatcaaagagtgatcacgggcaagtcctttactgtctttaggaataagctagcccttttaggggcagttcttcctgaggtcagcaaggacccagatgccaggtggttaaaaatatgaaaaaataagaaaacagtcaatataccttactttcttagaaatctctcacacataatgacccccatggcccctattctattggtatcatctcctgatgtaatctctcagtggctgttgccccacggattctctccaaatcacaaaatttgcattcctagaagaggaactgtgtttggcttcacaatctgttagagcaaaccttaagatgtctcagcaggggccaggtggactgagcagtttcccccaggagaggtttgtgggtctagcagagaccatgattattatatgtgattggtactgagtttaagaagggaaaagacaggctgggtgcagtggctcatgcatgttatgccaacattttgagaggccgaggtggacggatcacctgaggtaaacactagcgtggccaacatggcaaaacactgtctctactaaaaatacaaaaattatctgggcatggtggcacatgcctgtaatcccagctactccataggctgaggcaggagaattgcttgaacctgggaggtggagtttgcagtgagccaagatcatgccactgcgttccagcctgggtgacagagtgagactccatcaaaaaaaaaaaaggggaaaagacatgaaccttcaccctcaaagagcttccaatataaaaaagaaaaaaaaagttcatatgaataacatagttcatttgaaaaagctttgtacaaacagcaaagtaatatatggataatacatgtatatatatacacatataatatatgtatatagtaatatatggatttttaaaattgtagtgataataataatagtaatatttaacatgtacatacttcttattaaatgccagaattgttttccaagtgctttacatgtatattctcatttaatcctcagaacaaccctattacgagggttttataattacaataattttatagatgataaaagtcacagaaaggttaagtaacttgctcaaggatacatggatcatgacagagctgagattgaaacccaggattttgatgattgtgctgataggcagtatatatacttctactgtaggtggacaaccatattctcacaatgtgacatatcagacttcatataaaaatagctaaaggcctgtacattaagcctttcagtagtacgtgcacatcattttatttgctatgtattatggactgtatgtgtctcccccaaagaaattcatatactgaaaccttaatccccgatgtattgatatctggagatgaggctttctggaggtaattaagtcatgaaggtgaagctgttatgatgagattagtgccttataagaagagatggagagagctttctgccttcccccactctatgtggggatataaccaggaagagggcccttgccagagaccagatatgttggcatcttgatcttggacttctcagtctctaggcctgtgagaaatagatgcttatgtgaccagtctatggtatttgttatagtagtctaaactgactaagacactatgtaattcatctgaatattattgaagttattactcttgaaaaatggctttagtccaaggaaagattacacatgtgtaggttgagtgtccctaatccaaaaatcctaaatctgtaatgctccaaaattgaacatttttgagcactaacatgatgctcaacgtgcatattcattggagcatttcagattctggatgctcagttggtgaactataatgcattaaaatgctcttgaatttaatgaaatcgaaggttggtgtttggatggtcttcaggtttttggattaaagatgctcaaccaatttggtataatgcaaatattccaaaattccaaaaatctgaaatgtgaaacatttgtgtttctaagcattttgggtaagagatgttcaacctgtgtaataatgcaaagataatgtggttcatacgcttggatgacatttttagacatattcatagcctttagggaatggacatttgaaaaaatatagttttcctagtgacctgggcttactcttccccaggaaggttgatattgccatgtaaccaggattcagtttcttcttataaggaagcaacatatccttcattacattaacatgcaatagaaagttccacttagtgatatttcactgaaccagtcacaatctcagcactgccttgttcaaacaaaagaactctctccagcataaaacccaaacaaccagatggcgaactagtacatcctatacgtgttgctactcaagtatgttttccaacatcttggctgccagggaatgacactgatagcgtaaatatgtcagtgataatttgtcagtatggcctactaatgacagaaactgtgacttcaaaatgatttaaaaggttgtctaagcaatagctagctgtcaacccagaaattttgaatggtatctttgcagtagaatgagcatgaagatagcaagtgaattatgaattcttctagattttagtaggtacccttttaagtacatggaagccagagaagtgccatcaatgacttgcaaaaagaaccctgtgagttatggctatctatttaagaaaaagaaggtaagactttcatcaacactttacaacattctacaagtacacaattttattgctgtcttttctttattcttatttgtatgcacatcccaaatctaacatggtacattattctttaaaaacataattattttcctggtttgaattaagatgtaatatgaccttttagaagaaaacagagccattgcatgttttgtttgtatacttcttatacaaaataaatgtagtcatgtgccttgaaaaaagtgagggacatatatatatatagtcacctcaagaaatagactgtgatgaaagattcacaaatagaaagcaacacaggaaagacattgctgattatgcagttttagaagcagggtcaagaaagagtgagtaaaagaaaaagatatacatttatagtagaaagcaaacaaaaatctccattgtgaaaatcacttccaaatcatttccccataatatagggaaactgatgatagtctacttgctgtggccttcaattcttaggcaatatttttatatattccggagaaaatcattgagatttgctttgcatgcaattctacttcagctcctttctaactggccaaatctatcccttttatttatgaatttgattataatgttaacaacaaccacaactaaacccaaataatgtactggcccgggaataaggcatacaaactgcaaataaatgtatttaggcagatattagtatcttgaatcagaagtacatgttaaaatattattggacttcctctttgaaaagaaagttggttttgttactttatttacttatcaggttttattgcaggccatattatatttcgacagttctgtaatgaaagtgtattctggactgcagagtggtgctaaattctcagataatggaataaaactgctttgaaaaaacatatttaactcaagtatagtttgtccagttcagtttagaagtgactttgcctgaaaaggaaatcgtgtaattctaggaaagagcaaagatttttctaaaatggagaaaaggtattgaaaacattgcttttacttttagaaagaaagtgtggcaggtcatgagagaaatcaaagtcaggacagcagtcattctcctgcagaaaatgcaggcacgtgagcagagagtgctatagaaagtgccttcttcttttcctcaggtcacccgctgggcttgggaaagggttccttcactaccaaagtacttcagttatttctctcatgtccgagacctgtctgtagtagcatctaatacaaatctggaatacttccattgagggaattcttgtctaactcttagtggaccttaacattccagcaggctgggaacaggaagtagagtcttgagtacttctatgaccacctcccttgtctactatatattcctgttctcctcctcattgtgtccttacgaaatttgcatttggactgttagtcttggtctttggatcttttaaatcatttaagaataaggtcattactctgggtcttttaatctgctcttaactcctcaaacctgatctacaaagtgtgattagaaggtgctgttcttagtcctgttatgaaataaaaggtcatatttagcacataaaattcttatctattactttaaatacattttctctttcagtattaaactcttgctctgaaatttaacaacggtgaaactttcatgaacgtgagaaagccatatatgttatcacttactaataagcagtaatgataataatagaagtagaaattagtttaaaaataaatgtatttggcaatgaacataaagtgttacacagtgactgagattgctaacagtgattcttaattattcttgatgttatagtcgtgggaattcttttgaaagaccacagagaagggggagataaaaggatcatgagatgaacccctgaagtttactttggagaatttctatttctaaaaccatatccaaattattagtactctaaaaaataccatcagtcaaagtaaattggctacggtaaaacagaaaaaagccatcgataattaaattttgggtaatgtgtgaaaattatgaataatttatgttccagacatatctgactgactttggttcattgtcttgactattggggtactggtataggaaggaatgatgtgttttcagcgtggaaaatatttatggtatagttgtgttataattatattgtcaaaaaacttgtttttaaatacatagtccacctgactgaggcattattaatctctactgtagatagataatcttgagagacatttgacagttgaatccgacatggaggaaggcatttgaggttaggttaaatgtataaatacagtatattccacagaaattagtgatgggaaaagcaaaaacactggcattcaattatagagaaaccattgttttcgtttcttgcttggattgtgtgcacagtatagaacttaatagcaagcagagatttcccatggagagttcatgacaggcaacaggttagtgggagagacatagcttgcactcctgcagcagtttgatcagaagattccttgcactctcagatgctcaagaggataataaactgactggcatagcaacacagaaatctggaagattatatacaaatataaaattgctacgctacactgtttcagctaagcctcccagagatactcatatcaggtggcacggataaaggacatcatggtgttctgcaaaatgatacacaagtgtgtcatgtcacacactgggaaaacttagccaccttaaattgtgaaatagaaagtaggctatcctttcctttacaaaaatatggctgcctgatgttggtaagtccatcctgtaagatctttctcctttctcaagcccagagttggaggattggcataccctttgcctgtagattcctcctcagaccaagagggtaagtagaaatccaatcatgatacagaagggttctgtaattttcagagtacacaggctcctctgaacctaagtggactctgcagttgttggaacaaatacacatatccttagtctctttgggattctctttctgaagggttgggtatgaatcactgtgctgcctgggtcccctgaagtcagttctagcaactggtctctcctaacctgcagagcatgagctgtgcaaatatgatacaggcagagatgacccctacaaaaaaaatgaaggagatgttggcagcccctaagaagagtagaagctattactcctggagatgttgggaagctggaagtaggtcagcaatgcagatgactgaggagatgaatagaaccaggagcaggaagtagggatgggtttacacttgactgggaaagactcagctagaggcctgtcactggactcccaattgctttagagaagaaagtgtgtaacagctatagcaaggaaatagagctaggttgaagtgtatcaaagtaaaaaggacaggaatagaattttttgatacagtggattgcttaaggagtgtcaggtagtctgacaaggagatgtgactggaagtaagatcacaaagaacatttaggactaacaagacagctgatgtgtttgaccagtttataaaaaaatactagaataaaaagaaagatctcacattgaagggaatacttttttgtccctgcaacatttattttaagttctggagtacatgtgcagtatgtgcaagttcgctacataggtaaaggtgtgccataacggtttgctgcacagataaagacattacctaggtattaagcccagtatccattagctattcttcctggtgctctccctcctccccctacaccgacagcccccagtgtgagttgttcctcccacatgtgtccatatgttctcattttccagctcccacttatacatgagaacatgtggtgtttggttttctgttgctttgttagttttttgaggaaaatgatttccagttgcatctttgtccctgcagaatacatgatctcattcctttttatggctgcatagtattccatggtgtatgtgtaccacattttctttatccagtctatcgttgatgggcatttgggtttattctatgtctttgctattgtgaatagtgctgcaatgaacatataattgcatgtatctttataatagaatgatttatatatttttgggtatatatagaaagtaatggaattgctgtgtcaaatggtatttctgcttctagatctttgaggagttgccaccctgtcttacacaatggttgaactaatttactctcccaccaacagtgtaaaatgtttctttttctctgaaaccttactagcgtctgttgattcttgactttttaataattgccattcttagtggtgtgagatggtctgtcattgagattttaatttgcatttctttaatgatcagtgatgttgagctttctttaatttttttggctgctcgaatgtcttattttgagaagtgtctgttcatgtcctttgcccactgttttttttttttttttccaagacgtagtcttgctctgtcacccaggctggagtgcagtggcacaatctcggttcactgcaacctctgcctcccgggttcaagcaattctcggacctcagcctcccaaatagttgggattacaggcacccatcaccgcacctggctaattttagtatttttagtggagagagggtttcaccttgttggccaggctggtcttgaacttctgacctcagcttgtgatctggccgcctcagtctcccaaagtgctgggattacaggcgtgagccattgtgcccagccctttgcctactttttaatggggttgttttgttttttctttcttttcttttcttttttttttttttgtaaatttatttaagttccttgtagactctggatattagactgggtagatcgcaaccttgtactcttgttacagccatttggttttgatgtgttatactgtcagatttaattttgcctttctttctctcttttttttttttttttgagatgagaccttgcttcatcacccaggctggagtgcagtagcttaatcatagcccactgcagcctcacattcctgggctcaggtgatcctcctgtctcagcctcctgagtggctgcgatgttttcttttcttctattattgtagagacagattcttgctatgttgcccagactggtctcaaacccctgagctcaagtgattttcccaccttagcctcctgaattactgggattacaggcatgaaccattgctgtgccttattttttgatttt

SEQ ID NO: 3237 - DNA, 2972 bp, Homo sapiens
ataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactaactcttaagatacttgtagaatgtgtgatcacagtgctctccctgttaccataggacaccttccctattgcaatagtgcctttactccttttgcaataattattttgaatgaagtctcttcttactaactctggatttgcttttatttgacaatagcatatggtgagtttgtgaccagaggcaaacggccaaggccaatgactccagctgtgaatgccagtaggatgccccaaggcccagatggggccctctgcaccccagggacaagaccagacaaattgctccatggtatgtaggccagtggggatcagaggatgatggttagatttggagctcctttgccacagataaggggtctcatcatgccctccttcagccagttgatattttggagaactggggctgcagtgctcccaaggactgacaactcagaagaaataaactgtttcttccagcttaaaagtcttttttgaatgtaatattgttacagaaaagtatgtgtgtgtgtgtgtgtgtgtgtgtgtgtgtgtctgttaccagcaaggacttatgaagcttatgagggtgactaactctgttaaaaaaaaatagacaaaagccacattttcttagtgcagttgacagtagtgtgtgcaaatttgccaccagctatactagaattacgaatcaaagaaaacaagatgatatttcacagcaataaatgtgaaatcttgcctttgggttcaaaaacatgtaagtacaggatgtgaatatttggtttaggaacagcacggcaatactcaggaagaaaaaattagtggttgtattagtcaggaattttttggttgccacttacaaaaatccaactgggattaggcaaaagggcaaaaagggaatttattgactctcagaatccaagaacaaccagactgagggaagggcagggaaggctgctaggtttcagggataaatgggcaagggacacaaaagccctgggttctctccgtttcttgactgggctggcctctctttgggtggcattctctcttctgtgttttattctctcttgctacagtctatctttctgcacagggcaggattatggcccttaaacgcttctgaagatcatcccttctaacttttgctagtggacttggaagaggctggctctttcagatgcagccagacaagacctgaggaagaattctgatgggaaacctgcaaagacatcctcaatggtaaattttagccatcttcaataaaaaagggaggacttagagaatttgtgagaaggattcacttctgtatcccccaccctcaagagtgtttttcacatggtgagttgtgtcttaagaaatcaattttgtgtttcacaactagcattttttaaataacaaaatacaattgaatggaatgaaatagaacagacaaaaatattgagtttacaacatatagcaagagtaagttatgtttcataaaacgtatttcaggtaaacatgtgtgtgtgcaacatcatacatgtcatgttgtaaaatatatttttactgtcagttgtagcccaaacaaaagtttgaaaaatattgtcttaagtttaccctctggaaaagtacaatttgactttgatctgaatgagttggtcttattaaagaatcaagatggtgttggctagactagcttttgccttgtggtgggttctaagaatatttttattttttctatgtcccatatcagatgagtgggagtctctcagtttttcaagtcctctcaggaagcaaaacaaaatgaagtaataacaattgcttcctacttacctaagcaaatgctttttgcttgtgatttccccaggactgttacaggagatgaagacttgatcagtgtttctaagtacctttgaggattagagtaatcagtaatgcatatctgtcatccataaaagcaaatgtgtacttcctactggacttttccatttgctgaagtcaggagaaccaacatggcttgtttgaattaaataaggtcactgttcgaagaatcaatcttgaggaagagaagtaagagccagtagtagtattgcaaagcataaccctgttcccaaagacacgctgagccctggagactagggcatgaggcaaaggagctgaagaacgctcaaaactgttctcaatgattattccattttggggcaaatgtacatgaaaatggtagtaccagagaaacagctatatgccagaaagcctgagctctgaagagaggcatggagaactcaatttcactaagtccagaggatgactaaaaatgccaagataggctcaaggtgaaatagatcccactggaagttcagaaggacagttttgagggtttctaccccagggaaaccacttagaattgtaaactggatgtttacatgatgaaattggccttgagcctgtgccacccagatgccaaaacaaaacaaaatgaaacaaaaacaccccaaaactcaaaacaattctttggccaaactgataatgagtaatgattaacaaaatgttcttttccttggtgagatgcctggaagaaagactctgtatctcctaggtggcttaaagaagcctgtgtgttctcatatcctggggaggtgaaggcagagctaacgcctctcctactggtgaagttccctg

SEQ ID NO: 3238 - DNA, 521 bp, Homo sapiens
ctttagaagtgaaagctttaatcccgtgattcatgaaagcaaagtggtaataatttaagtaccatattttatttatccctcagagttgtcaactgataccagaagtatttccactcttttggggttgctgcctttggccatctaattgcttcttaggaaggaagagggaaattgcttctagaactacgcggattgtctttggcagcgtcgagctgaggcatcaatcagtccatctggtcttaggtttatgcctgtacctccatagactgcttacttcatttagttattcaaaaaccataattagtgcagtaattaacgtgtggatccttcaaaggaagactgctagaatcatgggacgtgtctcatcattcttactgatgtgtggatgataaagagactgaggctgctgtgacaacaggacttgtattactgcacagtaacggtgctgcagggaaattcagacaggaccttggtccacagagccccaacgtttgaaaaaagtaattatccacactgtttcc

SEQ ID NO: 3239 - DNA, 20 bp, Artificial Sequence
  a primer for Lnc21524 (Lnc21524Se)
ttgaatcctggctttgctct

SEQ ID NO: 3240 - DNA, 20 bp, Artificial Sequence
  a primer for Lnc21524(Lnc21524As)
ggaaaggcaattgagtgagg

SEQ ID NO: 3241 - DNA, 20 bp, Artificial Sequence
  a primer for Lnc23749 (Lnc23749Se)
ttggtctttcacccttcctg

SEQ ID NO: 3242 - DNA, 20 bp, Artificial Sequence
  a primer for Lnc23749 (Lnc23749As)
gaaaacgtcctccctccttc

SEQ ID NO: 3243 - DNA, 20 bp, Artificial Sequence
  a primer for Lnc19889  (Lnc19889Se)
acacgggaagctctttgaga

SEQ ID NO: 3244 - DNA, 20 bp, Artificial Sequence
  a primer for Lnc19889 ( Lnc19889As)
tcaagagggaaggatggatg

SEQ ID NO: 3245 - DNA, 20 bp, Artificial Sequence
  a primer for LncAnx5a (LncAnx5aSe)
gaatttctggggacctttcc

SEQ ID NO: 3246 - DNA, 20 bp, Artificial Sequence
  a primer for LncAnx5a LncAnx5aAs)
gcaaagggagagaaagcaga

SEQ ID NO: 3247 - DNA, 120 bp, Artificial Sequence
  A FIMICS probe for lncRNA (SEQ1204)
gttctactcaaagggtcagtttagggcataattaaagtcaattactttctgaaaggccatcaggacaactgttagagaaaatgatagcagccccgcacttgctgtaggaattattagctt

SEQ ID NO: 3248 - DNA, 120 bp, Artificial Sequence
  A FIMICS probe for lncRNA (SEQ1204)
caggacaactgttagagaaaatgatagcagccccgcacttgctgtaggaattattagcttgtcagcctccaggcttatggagacaaaggatcaaaaagttagagagatccaggtgttcac

SEQ ID NO: 3249 - DNA, 120 bp, Artificial Sequence
  A FIMICS probe for lncRNA (SEQ1204)
gtcagcctccaggcttatggagacaaaggatcaaaaagttagagagatccaggtgttcacctatttgttcactaattcttttattgtgagtgtgcatgtgtgtgggtgggtgtgacattt

SEQ ID NO: 3250 - DNA, 120 bp, Artificial Sequence
  A FIMICS probe for lncRNA (SEQ1204)
ctatttgttcactaattcttttattgtgagtgtgcatgtgtgtgggtgggtgtgacatttattatgaaccagagggcaggagccagtgacacagtggtgcagagaataatcatattccct

SEQ ID NO: 3251 - DNA, 120 bp, Artificial Sequence
  A FIMICS probe for lncRNA (SEQ1204)
attatgaaccagagggcaggagccagtgacacagtggtgcagagaataatcatattccctgccttcctggggtcatacagcttggtggaggacacagatgtgaattcggtaatcactcca

SEQ ID NO: 3252 - DNA, 120 bp, Artificial Sequence
  A FIMICS probe for lncRNA (SEQ1204)
gccttcctggggtcatacagcttggtggaggacacagatgtgaattcggtaatcactccaataaatattctcctacagatgaagaaagatgatacgatgtgatggacaacagagacttat

SEQ ID NO: 3253 - DNA, 120 bp, Artificial Sequence
  A FIMICS probe for lncRNA (SEQ1204)
ataaatattctcctacagatgaagaaagatgatacgatgtgatggacaacagagacttatatggtggggtctgggctggtctttctgaagctaagactggcaggatgagcaggagtttgc

SEQ ID NO: 3254 - DNA, 120 bp, Artificial Sequence
  A FIMICS probe for lncRNA (SEQ1204)
atggtggggtctgggctggtctttctgaagctaagactggcaggatgagcaggagtttgccagacaaagaggagtggagttgttttccaaacacatctcagcacaaagtgttgtctttgc

SEQ ID NO: 3255 - DNA, 120 bp, Artificial Sequence
  A FIMICS probe for lncRNA (SEQ1204)
cagacaaagaggagtggagttgttttccaaacacatctcagcacaaagtgttgtctttgctgggagctgaaaaaagatagtgtgggcagagaccattaggtgagacgcttgatatgagat

SEQ ID NO: 3256 - DNA, 120 bp, Artificial Sequence
  A FIMICS probe for lncRNA (SEQ1204)
tgggagctgaaaaaagatagtgtgggcagagaccattaggtgagacgcttgatatgagatacaacctcaacaggtggaagaagatcatgagagatgaagagaggaatatagtacagcaga

SEQ ID NO: 3257 - DNA, 120 bp, Artificial Sequence
  A FIMICS probe for lncRNA (SEQ1204)
acaacctcaacaggtggaagaagatcatgagagatgaagagaggaatatagtacagcagagaggacacagaagctgacgtcagggtgtctcagtttgaaaccagtggccaccctgttcct

SEQ ID NO: 3258 - DNA, 120 bp, Artificial Sequence
  A FIMICS probe for lncRNA (SEQ1204)
gaggacacagaagctgacgtcagggtgtctcagtttgaaaccagtggccaccctgttcctctcccatgtggtcccatcatgggcctctagggtctgggataagaggttaatgaatatctc

SEQ ID NO: 3259 - DNA, 120 bp, Artificial Sequence
  A FIMICS probe for lncRNA (SEQ1204)
ctcccatgtggtcccatcatgggcctctagggtctgggataagaggttaatgaatatctcataccctaagcaggggtggtccctgcactttagcaaaaagttaaggaactagggaaaaga

SEQ ID NO: 3260 - DNA, 120 bp, Artificial Sequence
  A FIMICS probe for lncRNA (SEQ1204)
ataccctaagcaggggtggtccctgcactttagcaaaaagttaaggaactagggaaaagagatggaaataataaagagatgggacaaagactttgaagaccaaagcccctgggctattct

SEQ ID NO: 3261 - DNA, 120 bp, Artificial Sequence
  A FIMICS probe for lncRNA (SEQ1204)
gatggaaataataaagagatgggacaaagactttgaagaccaaagcccctgggctattctcttttttaaatttttttatttaaattttcatttatttttatcaagatagggtctcactat

SEQ ID NO: 3262 - DNA, 120 bp, Artificial Sequence
  A FIMICS probe for lncRNA (SEQ1204)
cttttttaaatttttttatttaaattttcatttatttttatcaagatagggtctcactatgttgcccaggttggtctcaaacttttggcctaaagcaatcctcccaccttggcctcccaa

SEQ ID NO: 3263 - DNA, 120 bp, Artificial Sequence
  A FIMICS probe for lncRNA (SEQ1204)
gttgcccaggttggtctcaaacttttggcctaaagcaatcctcccaccttggcctcccaatgtgctgggattacaatgtgagccaccacgtccagcctcctgggatatttctcaatgaaa

SEQ ID NO: 3264 - DNA, 120 bp, Artificial Sequence
  A FIMICS probe for lncRNA (SEQ1204)
tgtgctgggattacaatgtgagccaccacgtccagcctcctgggatatttctcaatgaaacattggatgccaagattggttttgtgccacatgccaatttcacagaagccagtctatgag

SEQ ID NO: 3265 - DNA, 120 bp, Artificial Sequence
  A FIMICS probe for lncRNA (SEQ1204)
cattggatgccaagattggttttgtgccacatgccaatttcacagaagccagtctatgagccaccagctctactcagcaattacagtttctggaactttggctaaattcctgtagatgca

SEQ ID NO: 3266 - DNA, 120 bp, Artificial Sequence
  A FIMICS probe for lncRNA (SEQ1204)
ccaccagctctactcagcaattacagtttctggaactttggctaaattcctgtagatgcaccactgcttgtggcctgactctttgccacccaagtgcgctcagcctcccctggggagtct

SEQ ID NO: 3267 - DNA, 120 bp, Artificial Sequence
  A FIMICS probe for lncRNA (SEQ1204)
ccactgcttgtggcctgactctttgccacccaagtgcgctcagcctcccctggggagtctgccaggcttgcatggctcccactgcacttgctgtgctgggaccgaaaacagtttttgtgc

SEQ ID NO: 3268 - DNA, 120 bp, Artificial Sequence
  A FIMICS probe for lncRNA (SEQ1204)
gccaggcttgcatggctcccactgcacttgctgtgctgggaccgaaaacagtttttgtgcccctagcttaactccactggattcatagaggctttggcctcctcaatggctgtcctggga

SEQ ID NO: 3269 - DNA, 120 bp, Artificial Sequence
  A FIMICS probe for lncRNA (SEQ1204)
ccctagcttaactccactggattcatagaggctttggcctcctcaatggctgtcctgggacagggaggctggttagcacaattaacacaacctggtcatgcaaggcattgatggtccgta

SEQ ID NO: 3270 - DNA, 120 bp, Artificial Sequence
  A FIMICS probe for lncRNA (SEQ1204)
cagggaggctggttagcacaattaacacaacctggtcatgcaaggcattgatggtccgtaacatgaactttgaccagtaggagacagagaatggaaaaaagccagcagataaatcatctg

SEQ ID NO: 3271 - DNA, 120 bp, Artificial Sequence
  A FIMICS probe for lncRNA (SEQ1204)
acatgaactttgaccagtaggagacagagaatggaaaaaagccagcagataaatcatctggccttcctcccctatgacagactgttctgagccacagtgtttcacatgtcttcctggaga

SEQ ID NO: 3272 - DNA, 120 bp, Artificial Sequence
  A FIMICS probe for lncRNA (SEQ1204)
gccttcctcccctatgacagactgttctgagccacagtgtttcacatgtcttcctggagatgtcccacatgacttgagcaaccagctggagctctggagaaactgtggccatcctggtaa

SEQ ID NO: 3273 - DNA, 120 bp, Artificial Sequence
  A FIMICS probe for lncRNA (SEQ1204)
tgtcccacatgacttgagcaaccagctggagctctggagaaactgtggccatcctggtaacatatgaccttgtatttgctttctctccttcctgctttatttccctatgtcccttacttt

SEQ ID NO: 3274 - DNA, 120 bp, Artificial Sequence
  A FIMICS probe for lncRNA (SEQ1204)
ctgtggccatcctggtaacatatgaccttgtatttgctttctctccttcctgctttatttccctatgtcccttactttggttgttgggattgcacctcccaataaagcattagcatgtcc
